US012275967B2

(12) United States Patent
Huang et al.

(10) Patent No.: US 12,275,967 B2
(45) Date of Patent: Apr. 15, 2025

(54) PROCESSES FOR PRODUCING FERMENTATION PRODUCTS AND COMPOSITIONS USED THEREIN

(71) Applicant: Novozymes A/S, Bagsvaerd (DK)

(72) Inventors: Hong Zhi Huang, Beijing (CN); Jiyin Liu, Raleigh, NC (US); Hui Xu, Wake Forest, NC (US); Elena Vlasenko, Davis, CA (US); Brett McBrayer, Sacramento, CA (US); Ye Liu, Beijing (CN); Lan Tang, Beijing (CN); James Ron Huffman, Wake Forest, NC (US); Nikolaj Spodsberg, Bagsvaerd (DK)

(73) Assignee: Novozymes A/S, Bagsvaerd (DK)

( * ) Notice: Subject to any disclaimer, the term of this patent is extended or adjusted under 35 U.S.C. 154(b) by 0 days.

(21) Appl. No.: 17/642,925

(22) PCT Filed: Sep. 16, 2020

(86) PCT No.: PCT/US2020/050958
§ 371 (c)(1),
(2) Date: Mar. 14, 2022

(87) PCT Pub. No.: WO2021/055395
PCT Pub. Date: Mar. 25, 2021

(65) Prior Publication Data
US 2023/0012672 A1  Jan. 19, 2023

(30) Foreign Application Priority Data

Sep. 16, 2019 (WO) ............... PCT/CN2019/105905
Dec. 11, 2019 (WO) ............... PCT/CN2019/124568
Dec. 11, 2019 (WO) ............... PCT/CN2019/124571
Jan. 10, 2020 (WO) ............... PCT/CN2020/071436
Aug. 5, 2020 (WO) ............... PCT/CN2020/107055

(51) Int. Cl.
*C12N 9/24* (2006.01)
*C12N 1/18* (2006.01)
*C12N 15/81* (2006.01)
*C12P 7/06* (2006.01)
*C12R 1/865* (2006.01)

(52) U.S. Cl.
CPC ........... *C12N 9/2405* (2013.01); *C12N 1/185* (2021.05); *C12N 15/81* (2013.01); *C12P 7/06* (2013.01); *C12Y 302/01058* (2013.01); *C12Y 302/01075* (2013.01); *C12N 2800/102* (2013.01); *C12R 2001/865* (2021.05)

(58) Field of Classification Search
None
See application file for complete search history.

(56) References Cited

U.S. PATENT DOCUMENTS

| 7,109,014 | B1 | 9/2006 | Yamamoto et al. | |
| 10,174,344 | B2 * | 1/2019 | Soong | C12P 7/14 |
| 10,640,794 | B2 * | 5/2020 | Soong | C12P 7/065 |
| 11,085,061 | B2 * | 8/2021 | Quinlan | C12P 7/28 |
| 11,220,679 | B2 * | 1/2022 | Tsutsumi | C12N 9/2402 |
| 11,326,187 | B2 * | 5/2022 | Gaspar | C12P 7/06 |
| 11,795,481 | B2 * | 10/2023 | Gaspar | C12P 7/06 |
| 2003/0115627 | A1 | 6/2003 | Laroche et al. | |
| 2016/0186153 | A1 | 6/2016 | Suzuki et al. | |

FOREIGN PATENT DOCUMENTS

| DE | 112014003580 | | 5/2016 |
| EP | 1205545 | A1 | 7/2000 |
| WO | 1995031533 | A1 | 11/1995 |
| WO | 1995031534 | A1 | 11/1995 |
| WO | 2000018931 | A1 | 4/2000 |
| WO | 2000075159 | A1 | 12/2000 |
| WO | 2004087889 | A1 | 10/2004 |
| WO | 2008023060 | A1 | 2/2008 |
| WO | 2010115156 | A2 | 10/2010 |
| WO | 2011098577 | A1 | 8/2011 |
| WO | 2012021883 | A2 | 2/2012 |
| WO | 2012084225 | A1 | 6/2012 |
| WO | 2013177714 | A1 | 12/2013 |
| WO | 2013181760 | A1 | 12/2013 |
| WO | 2014059541 | A1 | 4/2014 |
| WO | 2014081700 | A1 | 5/2014 |
| WO | 2014081884 | A1 | 5/2014 |
| WO | 2014127852 | A1 | 8/2014 |
| WO | 2014138983 | A1 | 9/2014 |
| WO | 2014202616 | A2 | 12/2014 |
| WO | 2015048332 | A2 | 4/2015 |
| WO | 2016020100 | A1 | 2/2016 |
| WO | 2016020103 | A1 | 2/2016 |
| WO | 2016020468 | A1 | 2/2016 |
| WO | 2016090473 | A1 | 6/2016 |
| WO | 2016109758 | A2 | 7/2016 |
| WO | 2016210238 | A1 | 12/2016 |
| WO | 2016018895 | A1 | 1/2019 |

OTHER PUBLICATIONS

Accession A0A1T3CWJ7. May 10, 2017 (Year: 2017).*
Accession A0A2P4ZLC4. May 23, 2018 (Year: 2018).*
Steindorff et al., 2018, Uniprot No. A0A2N1KYS0.

* cited by examiner

*Primary Examiner* — Christian L Fronda
(74) *Attorney, Agent, or Firm* — David A. Fazzolare

(57) ABSTRACT

The present invention relates to isolated polypeptides having beta-glucanase activity, catalytic domains, carbohydrate binding modules and polynucleotides encoding the polypeptides, catalytic domains or carbohydrate binding modules. The invention also relates to nucleic acid constructs, vectors, and host cells comprising the polynucleotides as well as methods of producing and using the polypeptides, catalytic domains or carbohydrate binding modules. The present invention further relates to processes for producing fermentation products from starch-containing or cellulosic-containing material, as well as an enzyme blend or composition, or a recombinant host cell or fermenting organism suitable for use in processes of the invention.

12 Claims, 21 Drawing Sheets

Specification includes a Sequence Listing.

PROCESSES FOR PRODUCING FERMENTATION PRODUCTS AND COMPOSITIONS USED THEREIN

CROSS-REFERENCE TO RELATED APPLICATIONS

This application is a 35 U.S.C. 371 national application of international application no. PCT/US2020/050958 filed Sep. 16, 2020, which claims priority or the benefit under 35 U.S.C. 119 of Chinese application nos. PCT/CN2019/105905 filed Sep. 16, 2019, PCT/CN2019/124568 filed Dec. 11, 2019, PCT/CN2019/124571 filed Dec. 11, 2019, PCT/CN2020/071436 filed Jan. 10, 2020 and PCT/CN2020/107055 filed Aug. 5, 2020, the contents of which are fully incorporated herein by reference.

This application contains a Sequence Listing in computer readable form. The contents of the electronic sequence listing created on Sep. 16, 2020, named SQListing.txt and 690 KB in size, is hereby incorporated by reference in its entirety.

BACKGROUND OF THE INVENTION

Field of the Invention

The present invention relates to polypeptides having beta-glucanase activity (e.g., beta-1,6-glucanase and/or exo- and/or endo-beta-1,3-glucanase activity), and carbohydrate binding modules, and polynucleotides encoding the polypeptides, and carbohydrate binding modules, and to nucleic acid constructs, vectors, and host cells comprising the polynucleotides as well as methods of producing and using the polypeptides, and carbohydrate binding modules for degrading beta-glucans. The present invention further relates to processes for producing fermentation products from starch-containing or cellulosic-containing material, as well as an enzyme blend or composition, or a recombinant host cell or fermenting organism suitable for use in processes of the invention.

Description of the Related Art

Beta-glucans are polysaccharides consisting of glucose units linked by beta-glycosidic bonds. Cellulose is one type of beta-glucan, in which all of the glucose units are linked by beta-1,4-glucosidic bonds. This feature results in the formation of insoluble cellulose micro-fibrils. Enzymatic hydrolysis of cellulose to glucose requires the use of endo beta-glucanases (e.g. EC 3.2.1.4), cellobiohydrolases (e.g. EC 3.2.1.91) and beta-glucosidases (e.g. EC 3.2.1.21).

Beta-glucans can also be linked by beta-1,3-glucosidic bonds (e.g., as found in the cell walls of baker's yeast, *Saccharomyces cerevisiae*), beta-1,6-glucosidic bonds as well as combinations of beta-1,3-, beta-1,4- and beta-1,6-glucosidic bonds. The combination of beta-1,3- and beta-1,4-glucosidic bonds can be found, e.g. in the soluble fibre from cereals such as oats and barley. In addition, storage polysaccharides found in algae contain 1,3-linked beta-D-glucose residues with various degrees of 1,6-branching. A subgroup of beta-glucanases, also known as laminarinases, can be classified as endo-1,3-beta-glucanases (EC 3.2.1.6 and EC 3.2.1.39) or exo-1,3-beta-glucanases (EC 3.2.1.58). Laminarinases can be used to catalyse the hydrolysis of the beta-1,3-glucosidic bonds, or beta-1,4-glucosidic bonds when the glucose residue whose reducing group is involved in the linkage to be hydrolysed is substituted at C3 to release glucose or oligosaccharides. These enzymes can act on laminarin, lichenin and cereal beta-D-glucans, but not on substrates containing only 1,4-bonds.

Other beta-glucanases (e.g. EC 3.2.1.4) can, for example, perform endohydrolysis of (1,4)-beta-D-glucosidic linkages in cellulose, lichenin and cereal beta-D-glucans and will also hydrolyze 1,4-linkages in beta-D-glucans containing 1,3-linkages. Still other beta-glucanases (e.g., licheninases EC 3.2.1.73)) can hydrolyze (1,4)-beta-D-glucosidic linkages in beta-D-glucans containing (1,3)- and (1,4)-bonds, but not on substrates containing only 1,3- or only 1,4-bonds.

A protein from *Rasamsonia emersonii* (SEQ ID NO: 25761 of WO2014/202616) is 54.3% identical to the beta-glucanase shown in SEQ ID NO: 8.

A protein from *Rasamsonia emersonii* (SEQ ID NO: 31658 of WO2014/202616) is 53.5% identical to the beta-glucanase shown in SEQ ID NO: 11.

A protein from *Rasamsonia emersonii* (SEQ ID NO: 26759 of WO2014/202616) is 53.4% identical to the beta-glucanase shown in SEQ ID NO: 14.

A protein from *Rasamsonia emersonii* (SEQ ID NO: 26759) is 49.8% identical to the beta-glucanase shown in SEQ ID NO: 17.

A protein derived from Ascomycota (SEQ ID NO: 589 of WO2016/090473) is 66.1% identical to the beta-glucanase shown in SEQ ID NO: 20.

A protein from *Trichoderma harzianum* (SEQ ID NO: 4 of WO9531534) is 85.7% identical to the beta-glucanase shown in SEQ ID NO: 23.

A protein from *Trichoderma harzianum* (SEQ ID NO: 4 of WO9531534) is 76.8% identical to the beta-glucanase shown in SEQ ID NO: 26.

A protein from *Trichoderma harzianum* (SEQ ID NO: 25891 of WO2015/048332) is 98.2% identical to the beta-glucanase shown in SEQ ID NO: 32.

A protein from *Trichoderma harzianum* (SEQ ID NO: 13 of WO2019/018895) is 82.1% identical to the beta-glucanase shown in SEQ ID NO: 35.

A protein from *Muscodor strobelii* (SEQ ID NO: 1613 of WO2010/115156) is 67.6% identical to the beta-glucanase shown in SEQ ID NO: 38.

A protein from *Trichoderma harzianum* (SEQ ID NO: 13 of WO2019/018895) is 87.7% identical to the beta-glucanase shown in SEQ ID NO: 41.

A protein from *Rasamsonia emersonii* (SEQ ID NO: 32154 of WO2014/202616) is 66.8% identical to the beta-glucanase shown in SEQ ID NO: 47.

A protein from *Myceliophtora thermophila* (SEQ ID NO: 186 of WO2012/021883) is 84.2% identical to the beta-glucanase shown in SEQ ID NO: 50.

A protein from *Myceliophtora thermophila* (SEQ ID NO: 1638 of WO2014/081700) is 77.1% identical to the beta-glucanase shown in SEQ ID NO: 53.

A protein from *Muscodor strobeli* (SEQ ID NO: 2093 of WO2010/115156) is 63.8% identical to the beta-glucanase shown in SEQ ID NO: 56.

A protein from *Muscodor strobeli* (SEQ ID NO: 2093 of WO2010/115156) is 83% identical to the beta-glucanase shown in SEQ ID NO: 59.

A protein from *Rasamsonia emersonii* (SEQ ID NO: 32154 of WO2014/202616) is 82.2% identical to the beta-glucanase shown in SEQ ID NO: 62.

A protein from *Thielavia australiensis* (SEQ ID NO: 947 of WO2014/138983) is 86.5% identical to the beta-glucanase shown in SEQ ID NO: 65.

A protein from *Muscodor strobeli* (SEQ ID NO: 34631 of WO2010/115156) is 47.7% identical to the beta-glucanase shown in SEQ ID NO: 68.

A protein from *Muscodor strobeli* (SEQ ID NO: 34631 of WO2010/115156) is 58% identical to the beta-glucanase shown in SEQ ID NO: 71.

A protein from *M. thermophilum* (SEQ ID NO: 1485 of WO2013/181760 is 86% identical to the beta-glucanase shown in SEQ ID NO: 74.

A protein from *T. harzianum* (SEQ ID NO: 13 of WO2019/018895) is 80.5% identical to the beta-glucanase shown in SEQ ID NO: 77.

Proteins from *Penicillium chrysogenum* (SEQ ID NO: 60 of WO2016/210238) and *Aspergillus* fumigates (SEQ ID NO: 8 of WO2000/18931) are 80.1% identical to the beta-glucanase shown in SEQ ID NO: 80.

Proteins from *Rasamsonia emersonii* (SEQ ID NOs: 26759 and 31658 of WO2014/202616) are 52.3% identical to the beta-glucanase shown in SEQ ID NO: 83.

A protein derived from Ascomycota (SEQ ID NOs: 589 and 2388 of WO2016109758) are 68.9% identical to the beta-glucanase shown in SEQ ID NO: 86.

A protein from *H. hyalothermophila* (SEQ ID NO: 369 of WO2016/090473) is 65.4% identical to the beta-glucanase shown in SEQ ID NO: 89.

A protein from *H. lixii* (SEQ ID NO: 14 of WO2019/018895) is 94.8% identical to the beta-glucanase shown in SEQ ID NO: 95.

SEQ ID NO: 13 of WO2019/018895 is 87.3% identical to the beta-glucanase shown in SEQ ID NO: 98.

SEQ ID NO: 13 of WO2019/018895 is 87.3% identical to the beta-glucanase shown in SEQ ID NO: 101.

SEQ ID NO: 14 of WO2019/018895 is 91.2% identical to the beta-glucanase shown in SEQ ID NO: 104.

SEQ ID NO: 25889 of WO2015/048332 is 94.2% identical to the beta-glucanase shown in SEQ ID NO: 107.

SEQ ID NO: 972 of WO2014/138983 is 66.8% identical to the beta-glucanase shown in SEQ ID NO: 110.

WO2000/75159 discloses a sequence that is 64% identical to the beta-glucanase shown in SEQ ID NO:113.

SEQ ID NO: 972 of WO2014/138983 is 67.2% identical to the beta-glucanase shown in SEQ ID NO: 116.

SEQ ID NOs: 21464 and 25891 of WO2014/081884 and WO2015/048332, respectively, are 87.1% identical to the beta-glucanase shown in SEQ ID NO: 119.

WO2013177714 discloses a sequence that is 99.3% identical to the beta-glucanase shown in SEQ ID NO: 147.

SEQ ID NO: 454 of WO2014/059541 is 73.6% identical to the beta-glucanase shown in SEQ ID NO: 150.

SEQ ID NO: 26759 is 51.9% identical to the beta-glucanase shown in SEQ ID NO: 153.

Cereal grains containing beta-glucans are often used as a source of starch-containing material in processes for producing fermentation products from starch-containing material. Production of fermentation products, such as ethanol, from starch-containing material is well-known in the art. Industrially two different kinds of processes are used today. The most commonly used process, often referred to as a "conventional process", and includes liquefying gelatinized starch at high temperature using typically a bacterial alpha-amylase, followed by simultaneous saccharification and fermentation carried out in the presence of a glucoamylase and a fermentation organism. Another well-known process, often referred to as a "raw starch hydrolysis"-process (RSH process), includes simultaneously saccharifying and fermenting granular starch below the initial gelatinization temperature typically in the presence of at least a glucoamylase. The degradation of fiber in such starch-containing material to liberate residual fiber-bound starch to improve fermentation product yields is a recognized problem, and there is considerable interest in finding enzymes that can degrade the beta-glucans found therein. Furthermore, processes for producing fermentation products, such as the production of fuel ethanol from corn, are carried out under acidic pHs (e.g., less than about 7.5). Not all known beta-glucanases work well under these conditions.

Therefore, there is still a desire and need for providing processes for producing fermentation products, such as ethanol, from starch-containing material that can provide a higher fermentation product yield, or other advantages, compared to a conventional process.

SUMMARY OF THE INVENTION

The present invention provides novel beta-glucanases with improved properties (e.g., with significant improvement of performance and/or stability under acidic conditions).

The present invention provides isolated or purified polypeptides having beta-glucanase activity (beta-1,6-glucanase activity and/or exo- and/or endo-beta-1,3-glucanase activity and polynucleotides encoding the polypeptides.

Accordingly, the present invention relates to isolated or purified polypeptides having beta-glucanase activity (beta-1,6-glucanase activity and/or exo- and/or endo-beta-1,3-glucanase activity) selected from the group consisting of:

(a) a polypeptide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153;

(b) a polypeptide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to the sequence of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, SEQ ID NO: 120, SEQ ID NO: 145, SEQ ID NO: 148, SEQ ID NO: 151, or SEQ ID NO: 154;

(c) a polypeptide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to a mature polypeptide of SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153;

(d) a polypeptide encoded by a polynucleotide that hybridizes under medium, medium-high, high, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, SEQ ID NO: 152, or the cDNA sequences thereof;

(e) a polypeptide encoded by a polynucleotide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152, or the cDNA sequences thereof; and (f) a fragment of the polypeptide of (a), (b), (c), (d), or (e) that has beta-glucanase activity (beta-1,6-glucanase activity and/or exo- and/or endo-beta-1,3-glucanase activity).

The present invention also relates to an isolated or purified polypeptide comprising a carbohydrate binding module and a catalytic domain, wherein the binding module is selected from the group consisting of:

(a) a carbohydrate binding module having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to amino acids 311 to 347 of SEQ ID NO: 44 or SEQ ID NO: 45, or amino acids 323 to 359 of SEQ ID NO: 65 or SEQ ID NO: 66;

(b) a carbohydrate binding module encoded by a polynucleotide that hybridizes under medium, medium-high, or high stringency conditions with the full-length complement of nucleotides 1068 to 1178 of SEQ ID NO: 43 or the cDNA sequence thereof, or with the full-length complement of nucleotides 1021 to 1128 of SEQ ID NO: 64 or the cDNA sequence thereof;

(c) a carbohydrate binding module encoded by a polynucleotide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to nucleotides 1068 to 1178 of SEQ ID NO: 43 or the cDNA sequence thereof, or with the full-length complement of nucleotides 1021 to 1128 of SEQ ID NO: 64 or the cDNA sequence thereof;

(d) a carbohydrate binding module derived from amino acids 311 to 346 of SEQ ID NO: 44 or amino acids 311 to 346 of SEQ ID NO: 45 by substitution, deletion or addition of one or several amino acids in the amino acids 311 to 346 of SEQ ID NO: 44 or amino acids 311 to 346 of SEQ ID NO: 45, or derived from amino acids 323 to 359 of SEQ ID NO: 65 or amino acids 323 to 359 of SEQ ID NO: 66 by substitution, deletion or addition of one or several amino acids in the amino acids 323 to 359 of SEQ ID NO: 65 or amino acids 323 to 359 of SEQ ID NO: 66; and (e) a fragment of (a), (b), (c) or (d), that has carbohydrate binding activity.

The present invention also relates to isolated or purified polynucleotides encoding the polypeptides of the present invention; nucleic acid constructs; recombinant expression vectors; recombinant host cells comprising the polynucleotides; and methods of producing the polypeptides. The recombinant host cells (e.g., recombinant yeast host cells comprising heterologous polynucleotides encoding the polypeptides of the present invention) can be used for the in situ expression of at least one polypeptide having beta-1,6-glucanase activity and/or exo- and/or endo-beta-1,3-glucanase activity in processes, such as during the fermentation or simultaneous saccharification and fermentation steps of ethanol production processes, to replace or reduce exogenous addition of the polypeptides.

The present invention also relates to use of at least one polypeptide having beta-1,6-glucanase activity and/or exo- and/or endo-beta-1,3-glucanase activity for degrading a beta-glucan and processes of degrading a beta-glucan comprising contacting the beta-glucan with at least one polypeptide having beta-1,6-glucanase activity and/or exo- and/or endo-beta-1,3-glucanase activity, preferably wherein said beta-glucan is a beta-D-glucan, a beta-1,3-1,4-glucan, a mix-linkage beta-glucan, more preferably wherein said beta-glucan is a cereal beta-glucan, such as corn, wheat, rice, oats, and barley, wherein the process is carried out under acidic conditions having pH of 7.5 or less. In one aspect, the beta-glucan is degraded in a process for producing a fermentation product from starch-containing material, wherein a partially degraded starch-containing material containing beta-glucan is contacted with at least one polypeptide having beta-1,6-glucanase activity and/or exo- and/or endo-beta-1,3-glucanase activity during saccharification, fermentation, or simultaneous saccharification and fermentation to produce the fermentation product. In an embodiment, at least one polypeptide having beta-1,6-glucanase activity and/or exo- and/or endo-beta-1,3-glucanase activity is used to degrade beta-glucan during production of an alcohol, for example, by applying the at least one polypeptide during the saccharification, fermentation, or simultaneous saccharification and fermentation (SSF) step of a process for producing fuel ethanol from corn (including both conventional processes having a high temperature liquefaction step using enzymes (e.g., alpha-amylase and/or protease) and raw starch hydrolysis processes carried out below the gelatinization temperature of the corn). The at least one polypeptide can be applied by exogenous addition during the saccharification, fermentation, or simultaneous saccharification and fermentation (SSF) steps, or via in situ expression of the polypeptides during fermentation or SSF by a recombinant host cell (e.g., a recombinant yeast host cell comprising heterologous polynucleotides encoding at least one polypeptide having beta-1,6-glucanase activity and/or exo- and/or endo-beta-1,3-glucanase activity of the present invention).

The present invention relates to processes of producing fermentation products, such as ethanol, from starch-containing material or cellulosic-containing material, using a fermenting organism.

In an aspect, the invention relates to a process for producing fermentation products from starch-containing material comprising the steps of:

i) saccharifying the starch-containing material using a carbohydrate-source generating enzyme at a temperature below the initial gelatinization temperature;

ii) fermenting using a fermenting organism;

wherein at least one polypeptide having beta-1,6-glucanase and/or at least one polypeptide having endo- and/or exo-beta-1,3-glucanase activity are present or added during fermentation or simultaneous saccharification and fermentation.

In an aspect, the invention relates to a process for producing fermentation products from starch-containing material comprising the steps of:

i) liquefying the starch-containing material at a temperature above the initial gelatinization temperature using an alpha-amylase;

ii) saccharifying using a carbohydrate-source generating enzyme;

iii) fermenting using a fermenting organism;

wherein at least one polypeptide having beta-1,6-glucanase activity and/or at least one polypeptide having endo- and/or exo-beta-1,3-glucanase activity are present or added during fermentation or simultaneous saccharification and fermentation.

In an aspect, the invention relates to a process for producing fermentation products from cellulosic-containing material comprising the steps of:

i) optionally pretreating a cellulosic-containing material;

ii) saccharifying a cellulosic-containing material and/or pretreated cellulosic-containing material using a carbohydrate-source generating enzyme; and iii) fermenting using a fermenting organism;

wherein at least one polypeptide having beta-1,6-glucanase activity and/or at least one polypeptide having endo- and/or exo-beta-1,3-glucanase activity are present or added during saccharifying step ii) or fermentating step iii).

In an aspect, the present invention relates to an enzyme blend or composition comprising at least one polypeptide having beta-1,6-glucanase activity and/or at least one polypeptide having endo- and/or exo-beta-1,3-glucanase activity.

In an aspect, the invention relates to a recombinant host cell comprising a heterologous polynucleotide encoding at least one polypeptide having beta-1,6-glucanase and/or at least one polypeptide having endo- and/or exo-beta-1,3-glucanase activity.

In an aspect, the invention relates to a composition (e.g., fermenting or fermented mash composition) comprising: (i) a recombinant host cell or fermenting organism comprising a heterologous polynucleotide encoding an alpha-amylase, glucoamylase, and/or protease, and (ii) at least one polypeptide having beta-1,6-glucanase and/or at least one polypeptide having endo- and/or exo-beta-1,3-glucanase activity.

DEFINITIONS

Figure 1:
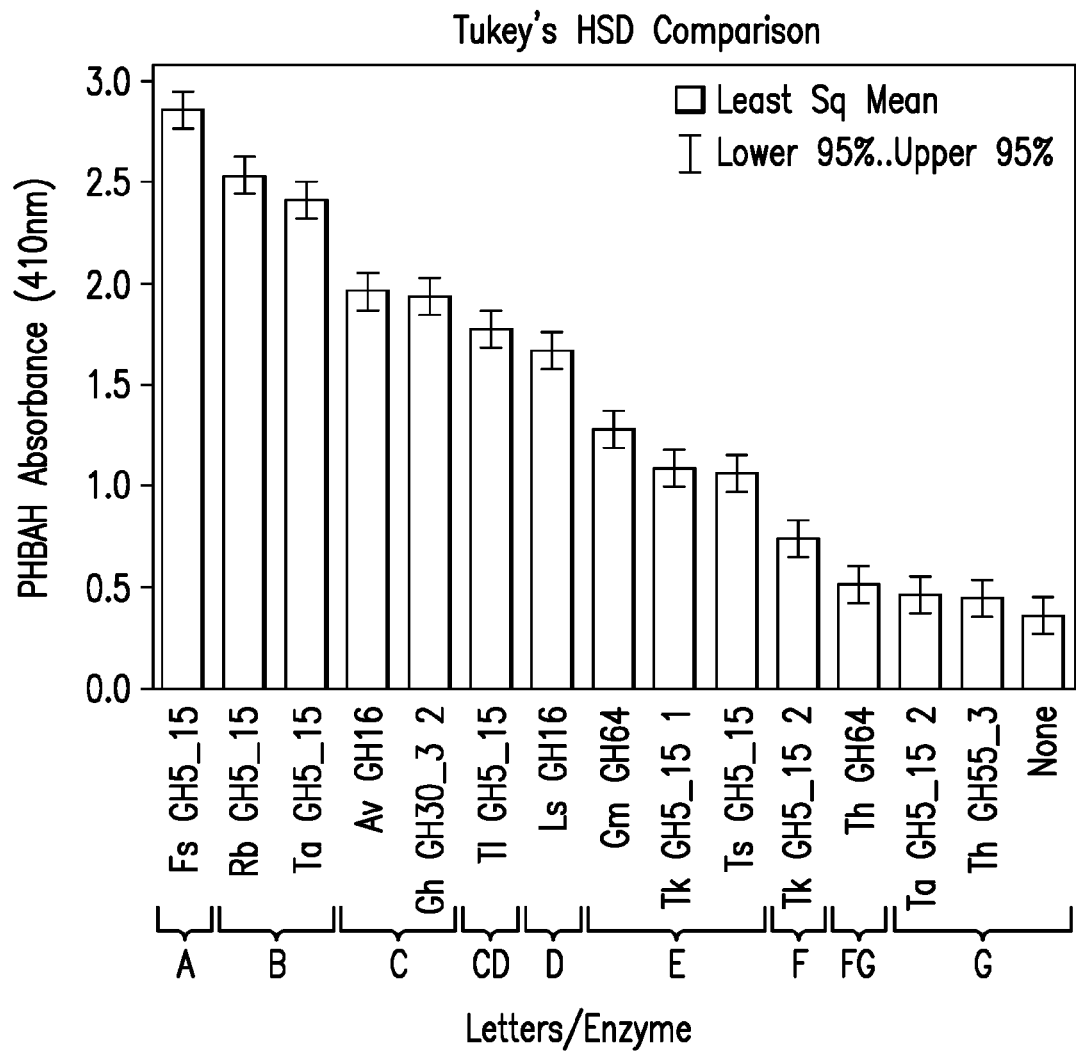
FIG. 1: Results of the experiment described in Example 29 ranked by Tukey's HSD procedure.

In accordance with this detailed description, the following definitions apply. Note that the singular forms "a," "an," and "the" include plural references unless the context clearly dictates otherwise.

Reference to "about" a value or parameter herein includes aspects that are directed to that value or parameter per se. For example, description referring to "about X" includes the aspect "X".

Unless defined otherwise or clearly indicated by context, all technical and scientific terms used herein have the same meaning as commonly understood by one of ordinary skill in the art to which this invention belongs.

Alpha-Amylases: Alpha-amylases (E.C. 3.2.1.1) are a group of enzymes which catalyze the hydrolysis of starch and other linear and branched 1,4 glucosidic oligo- and polysaccharides. The skilled person will know how to determine alpha-amylase activity.

Auxiliary Activity 9 polypeptide (previously named GH61): The term "Auxiliary Activity 9 polypeptide" or "AA9 polypeptide" means a polypeptide classified as a lytic polysaccharide monooxygenase (Quinlan et al., 2011, *Proc. Natl. Acad. Sci. USA* 208: 15079-15084; Phillips et al., 2011, *ACS Chem. Biol.* 6: 1399-1406; Un et al., 2012, *Structure* 20: 1051-1061). AA9 polypeptides were formerly classified into the glycoside hydrolase Family 61 (GH61) according to Henrissat, 1991, *Biochem. J.* 280: 309-316, and Henrissat and Bairoch, 1996, *Biochem. J.* 316: 695-696.

AA9 polypeptides enhance the hydrolysis of a cellulosic material by an enzyme having cellulolytic activity. Cellulolytic enhancing activity can be determined by measuring the increase in reducing sugars or the increase of the total of cellobiose and glucose from the hydrolysis of a cellulosic material by cellulolytic enzyme under the following conditions: 1-50 mg of total protein/g of cellulose in pretreated corn stover (PCS), wherein total protein is comprised of 50-99.5% w/w cellulolytic enzyme protein and 0.5-50% w/w protein of an AA9 polypeptide for 1-7 days at a suitable temperature, such as 40° C.-80° C., e.g., 40° C., 45° C., 50° C., 55° C., 60° C., 65° C., 70° C., 75° C., or 80° C. and a suitable pH, such as 4-9, e.g., 4.5, 5.0, 5.5, 6.0, 6.5, 7.0, 7.5, 8.0, 8.5, or 9.0, compared to a control hydrolysis with equal total protein loading without cellulolytic enhancing activity (1-50 mg of cellulolytic protein/g of cellulose in PCS).

AA9 polypeptide enhancing activity can be determined using a mixture of CELLUCLAST™ 1.5 L (Novozymes A/S, Bagsværd, Denmark) and beta-glucosidase as the source of the cellulolytic activity, wherein the beta-glucosidase is present at a weight of at least 2-5% protein of the cellulase protein loading. In one aspect, the beta-glucosidase is an *Aspergillus oryzae* beta-glucosidase (e.g., recombinantly produced in *Aspergillus oryzae* according to WO 02/095014). In another aspect, the beta-glucosidase is an

*Aspergillus fumigatus* beta-glucosidase (e.g., recombinantly produced in *Aspergillus oryzae* as described in WO 02/095014).

AA9 polypeptide enhancing activity can also be determined by incubating an AA9 polypeptide with 0.5% phosphoric acid swollen cellulose (PASC), 100 mM sodium acetate pH 5, 1 mM $MnSO_4$, 0.1% gallic acid, 0.025 mg/ml of *Aspergillus fumigatus* beta-glucosidase, and 0.01% TRITON® X-100 (4-(1,1,3,3-tetramethylbutyl)phenyl-polyethylene glycol) for 24-96 hours at 40° C. followed by determination of the glucose released from the PASC.

AA9 polypeptide enhancing activity can also be determined according to WO 2013/028928 for high temperature compositions.

AA9 polypeptides enhance the hydrolysis of a cellulosic material catalyzed by enzyme having cellulolytic activity by reducing the amount of cellulolytic enzyme required to reach the same degree of hydrolysis preferably at least 1.01-fold, e.g., at least 1.05-fold, at least 1.10-fold, at least 1.25-fold, at least 1.5-fold, at least 2-fold, at least 3-fold, at least 4-fold, at least 5-fold, at least 10-fold, or at least 20-fold.

The AA9 polypeptide can also be used in the presence of a soluble activating divalent metal cation according to WO 2008/151043 or WO 2012/122518, e.g., manganese or copper.

The AA9 polypeptide can be used in the presence of a dioxy compound, a bicyclic compound, a heterocyclic compound, a nitrogen-containing compound, a quinone compound, a sulfur-containing compound, or a liquor obtained from a pretreated cellulosic or hemicellulosic material such as pretreated corn stover (WO 2012/021394, WO 2012/021395, WO 2012/021396, WO 2012/021399, WO 2012/021400, WO 2012/021401, WO 2012/021408, and WO 2012/021410).

Family 61 glycoside hydrolase (now known as AA9): The term "Family 61 glycoside hydrolase" or "Family GH61" or "GH61" means a polypeptide falling into the glycoside hydrolase Family 61 according to Henrissat B., 1991, A classification of glycosyl hydrolases based on amino-acid sequence similarities, *Biochem. J.* 280: 309-316, and Henrissat B., and Bairoch A., 1996, Updating the sequence-based classification of glycosyl hydrolases, *Biochem. J.* 316: 695-696. The enzymes in this family were originally classified as a glycoside hydrolase family based on measurement of very weak endo-1,4-beta-D-glucanase activity in one family member. The structure and mode of action of these enzymes are non-canonical and they cannot be considered as bona fide glycosidases. However, they are kept in the CAZy classification on the basis of their capacity to enhance the breakdown of lignocellulose when used in conjunction with a cellulase or a mixture of cellulases.

Polypeptide having cellulolytic enhancing activity: The term "polypeptide having cellulolytic enhancing activity" means a GH61 polypeptide that catalyzes the enhancement of the hydrolysis of a cellulosic material by enzyme having cellulolytic activity. For purposes of the present invention, cellulolytic enhancing activity is determined by measuring the increase in reducing sugars or the increase of the total of cellobiose and glucose from the hydrolysis of a cellulosic material by cellulolytic enzyme under the following conditions: 1-50 mg of total protein/g of cellulose in PCS, wherein total protein is comprised of 50-99.5% w/w cellulolytic enzyme protein and 0.5-50% w/w protein of a GH61 polypeptide having cellulolytic enhancing activity for 1-7 days at a suitable temperature, e.g., 50° C., 55° C., or 60° C., and pH, e.g., 5.0 or 5.5, compared to a control hydrolysis with equal total protein loading without cellulolytic enhancing activity (1-50 mg of cellulolytic protein/g of cellulose in PCS). In an aspect, a mixture of CELLUCLAST® 1.5 L (Novozymes A/S, Bagsværd, Denmark) in the presence of 2-3% of total protein weight *Aspergillus oryzae* beta-glucosidase (recombinantly produced in *Aspergillus oryzae* according to WO 02/095014) or 2-3% of total protein weight *Aspergillus fumigatus* beta-glucosidase (recombinantly produced in *Aspergillus oryzae* as described in WO 2002/095014) of cellulase protein loading is used as the source of the cellulolytic activity.

The GH61 polypeptide having cellulolytic enhancing activity enhance the hydrolysis of a cellulosic material catalyzed by enzyme having cellulolytic activity by reducing the amount of cellulolytic enzyme required to reach the same degree of hydrolysis preferably at least 1.01-fold, e.g., at least 1.05-fold, at least 1.10-fold, at least 1.25-fold, at least 1.5-fold, at least 2-fold, at least 3-fold, at least 4-fold, at least 5-fold, at least 10-fold, or at least 20-fold.

Beta-glucanase: The term "beta-glucanase" encompasses polypeptides having beta-1,6-glucanase activity and/or exo- and/or -endo beta-1,3-glucanase activity. As used herein, "polypeptide having beta-1,6-glucanase activity and/or exo- and/or -endo beta-1,3-glucanase activity" means that the polypeptide exhibits at least one of these activities, but may also possess any combination of these activities, including all the activities. The term "exo- and/or -endo beta-1,3-glucanase" encompasses polypeptides that have either exo- and/or -endo beta-1,3-glucanase activity, both exo- and/or -endo beta-1,3-glucanase activities, as well as polypeptides having mixed beta-1,3(4) and/or beta 1,4(3)-glucanase activities. Preferably, the polypeptides having beta-1,6-glucanase activity and/or exo- and/or -endo beta-1,3-glucanase activity are members of a glycoside hydrolase family selected from GH30, for instance GH30_3, GH5, for instance GH5_15, GH16, GH55, for instance GH55_3, GH64, and GH131.

In one aspect, "beta-glucanase" means polypeptides having beta-1,6-glucanase activity referred to as 6-A-D-glucan glucanohydrolase (EC 3.2.1.75) that catalyze the random hydrolysis of (1→6)-linkages in (1→6)-β-D-glucans. In addition to acting on 1,6-oligo-beta-D-glucosides, members of this family of enzymes also act on lutean and pustulan. These beta-glucanases include members of the GH30_3, GH5_15 and GH131. For purposes of the present invention, beta-1,6-glucanase activity is determined according to the procedure described in the Examples. In one aspect, the polypeptides of the present invention have at least 20%, e.g., at least 40%, at least 50%, at least 60%, at least 70%, at least 80%, at least 90%, at least 95%, or at least 100% of the beta-1,6-glucanase activity of the mature polypeptide of SEQ ID NO: 2, SEQ ID NO: 32, SEQ ID NO: 35, SEQ ID NO: 38, SEQ ID NO: 41, SEQ ID NO: 77, SEQ ID NO: 80, SEQ ID NO: 92, SEQ ID NO: 95, SEQ ID NO: 98, SEQ ID NO: 101, SEQ ID NO: 104, or SEQ ID NO: 119. In another aspect, the polypeptides of the present invention have at least 20%, e.g., at least 40%, at least 50%, at least 60%, at least 70%, at least 80%, at least 90%, at least 95%, or at least 100% of the beta-1,6-glucanase activity of the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74.

In another aspect, "beta-glucanase" means polypeptides having beta-1,3-glucanase referred to as 3-β-D-glucan glucanohydrolases (EC 3.2.1.39), endo-1,3(4)-beta-glucanases (EC 3.2.1.6), or 3-β-D-glucan glucohydrolases (EC 3.2.1.58). 3-β-D-glucan glucanohydrolases (EC 3.2.1.39) catalyze the hydrolysis of (1→3)-β-D-glucosidic linkages in (1→3)-β-D-glucans. In addition to having some activity on mixed-link (1→3,1→4)-β-D-glucans, members of this family of enzymes also act on laminarin, paramylon and pachyman. Endo-1,3(4)-beta-glucanases (EC 3.2.1.6) catalyze the endohydrolysis of (1→3)- or (1→4)-linkages in β-D-glucans when the glucose residue whose reducing group is involved in the linkage to be hydrolysed is itself substituted at C-3. Members of this class may act laminarin, lichenin and cereal D-glucans. 3-β-D-glucan glucohydrolases (EC 3.2.1.58) catalyze the successive hydrolysis of beta-D-glucose units from the non-reducing ends of (1→3)-β-D-glucans, releasing alpha-glucose. Members of this class act on oligosaccharides, and on laminaribiose. These beta-glucanases include members of the GH16, GH55_3, GH64, and GH131 families. For purposes of the present invention, beta-1,3-glucanase activity is determined according to the procedure described in the Examples. In one aspect, the polypeptides of the present invention have at least 20%, e.g., at least 40%, at least 50%, at least 60%, at least 70%, at least 80%, at least 90%, at least 95%, or at least 100% of the beta-1,3-glucanase activity of the mature polypeptide of SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 83, SEQ ID NO: 86, SEQ ID NO: 89, SEQ ID NO: 107, SEQ ID NO: 110, SEQ ID NO: 113, or SEQ ID NO: 116. In another aspect, the polypeptides of the present invention have at least 20%, e.g., at least 40%, at least 50%, at least 60%, at least 70%, at least 80%, at least 90%, at least 95%, or at least 100% of the beta-1,3-glucanase activity of the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74. In another aspect, the polypeptides of the present invention have at least 20%, e.g., at least 40%, at least 50%, at least 60%, at least 70%, at least 80%, at least 90%, at least 95%, or at least 100% of the beta-1,3-glucanase activity of the mature polypeptide of SEQ ID NO: 144, SEQ ID NO: 147, SEQ ID NO: 150, or SEQ ID NO: 153.

Beta-glucanases used in the processes of the present invention are preferably the mature form, for example, as described in the definition of "mature polypeptide" below.

Beta-glucosidase: The term "beta-glucosidase" means a beta-D-glucoside glucohydrolase (E.C. 3.2.1.21) that catalyzes the hydrolysis of terminal non-reducing beta-D-glucose residues with the release of beta-D-glucose.

For purposes of the present invention, beta-glucosidase activity is determined using p-nitrophenyl-beta-D-glucopyranoside as substrate according to the procedure of Venturi et al., 2002, Extracellular beta-D-glucosidase from *Chaetomium thermophilum* var. *coprophilum*: production, purification and some biochemical properties, *J. Basic Microbiol.* 42: 55-66. One unit of beta-glucosidase is defined as 1.0 μmole of p-nitrophenolate anion produced per minute at 25° C., pH 4.8 from 1 mM p-nitrophenyl-beta-D-glucopyranoside as substrate in 50 mM sodium citrate containing 0.01% TWEEN® 20 (polyoxyethylene sorbitan monolaurate).

Beta-xylosidase: The term "beta-xylosidase" means a beta-D-xyloside xylohydrolase (E.C. 3.2.1.37) that catalyzes the exo-hydrolysis of short beta (1→4)-xylooligosaccharides to remove successive D-xylose residues from non-reducing termini. Beta-xylosidase activity can be determined using 1 mM p-nitrophenyl-beta-D-xyloside as substrate in 100 mM sodium citrate containing 0.01% TWEEN® 20 at pH 5, 40° C. One unit of beta-xylosidase is defined as 1.0 μmole of p-nitrophenolate anion produced per minute at 40° C., pH 5 from 1 mM p-nitrophenyl-beta-D-xyloside in 100 mM sodium citrate containing 0.01% TWEEN® 20.

Binding module: The term "carbohydrate binding module" means the region within a carbohydrate-active enzyme that provides carbohydrate-binding activity (Boraston et al., 2004, *Biochem. J.* 383: 769-781). A majority of known carbohydrate binding modules (CBMs) are contiguous amino acid sequences with a discrete fold. The carbohydrate binding module (CBM) is typically found either at the N-terminal or at the C-terminal extremity of an enzyme. Some CBMs are known to have specificity for cellulose. Carbohydrate binding modules of the present invention have cellulose binding (A-type) specificity.

Catalase: The term "catalase" means a hydrogen-peroxide:hydrogen-peroxide oxidoreductase (EC 1.11.1.6) that catalyzes the conversion of 2 $H_2O_2$ to $O_2$+2 $H_2O$. For purposes of the present invention, catalase activity is determined according to U.S. Pat. No. 5,646,025. One unit of catalase activity equals the amount of enzyme that catalyzes the oxidation of 1 μmole of hydrogen peroxide under the assay conditions.

Catalytic domain: The term "catalytic domain" means the region of an enzyme containing the catalytic machinery of the enzyme.

cDNA: The term "cDNA" means a DNA molecule that can be prepared by reverse transcription from a mature, spliced, mRNA molecule obtained from a eukaryotic or prokaryotic cell. cDNA lacks intron sequences that may be present in the corresponding genomic DNA. The initial, primary RNA transcript is a precursor to mRNA that is processed through a series of steps, including splicing, before appearing as mature spliced mRNA.

Cellobiohydrolase: The term "cellobiohydrolase" means a 1,4-beta-D-glucan cellobiohydrolase (E.C. 3.2.1.91) that catalyzes the hydrolysis of 1,4-beta-D-glucosidic linkages in cellulose, cellooligosaccharides, or any beta-1,4-linked glucose containing polymer, releasing cellobiose from the reducing or non-reducing ends of the chain (Teeri, 1997, Crystalline cellulose degradation: New insight into the function of cellobiohydrolases, *Trends in Biotechnology* 15: 160-167; Teen et al., 1998, *Trichoderma reesei* cellobiohydrolases: why so efficient on crystalline cellulose?, Biochem. Soc. Trans. 26: 173-178).

Cellobiohydrolase activity is determined according to the procedures described by Lever et al., 1972, *Anal. Biochem.* 47: 273-279; van Tilbeurgh et al., 1982, *FEBS Letters*, 149: 152-156; van Tilbeurgh and Claeyssens, 1985, *FEBS Letters*, 187: 283-288; and Tomme et al., 1988, *Eur. J. Biochem.* 170: 575-581. In the present invention, the Tomme et al. method can be used to determine cellobiohydrolase activity.

Cellulolytic enzyme, cellulolytic composition, or cellulase: Cellulolytic enzyme, cellulolytic composition, or cellulase: The term "cellulolytic enzyme", "cellulolytic composition", or "cellulase" means one or more (e.g., several) enzymes that hydrolyze a cellulosic material. Such enzymes include endoglucanase(s), cellobiohydrolase(s), beta-glucosidase(s), or combinations thereof. The two basic approaches for measuring cellulolytic activity include: (1) measuring the total cellulolytic activity, and (2) measuring the individual cellulolytic activities (endoglucanases, cellobiohydrolases, and beta-glucosidases) as reviewed in Zhang et al., Outlook for cellulase improvement: Screening and selection strategies, 2006, *Biotechnology Advances* 24: 452-481. Total cellulolytic activity is usually measured using insoluble substrates, including Whatman No1 filter paper, microcrystalline cellulose, bacterial cellulose, algal cellulose, cotton, pretreated lignocellulose, etc. The most common total cellulolytic activity assay is the filter paper assay using Whatman No1 filter paper as the substrate. The assay was established by the International Union of Pure and Applied Chemistry (IUPAC) (Ghose, 1987, Measurement of cellulase activities, *Pure Appl. Chem.* 59: 257-68).

Cellulolytic enzyme activity is determined by measuring the increase in hydrolysis of a cellulosic material by cellulolytic enzyme(s) under the following conditions: 1-50 mg of cellulolytic enzyme protein/g of cellulose in Pretreated Corn Stover ("PCS") (or other pretreated cellulosic material) for 3-7 days at a suitable temperature, e.g., 50° C., 55° C., or 60° C., compared to a control hydrolysis without addition of cellulolytic enzyme protein. Typical conditions are 1 ml reactions, washed or unwashed PCS, 5% insoluble solids, 50 mM sodium acetate pH 5, 1 mM $MnSO_4$, 50° C., 55° C., or 60° C., 72 hours, sugar analysis by AMINEX® HPX-87H column (Bio-Rad Laboratories, Inc., Hercules, CA, USA).

Cellulosic material: The term "cellulosic material" means any material containing cellulose. The predominant polysaccharide in the primary cell wall of biomass is cellulose, the second most abundant is hemicellulose, and the third is pectin. The secondary cell wall, produced after the cell has stopped growing, also contains polysaccharides and is strengthened by polymeric lignin covalently cross-linked to hemicellulose. Cellulose is a homopolymer of anhydrocellobiose and thus a linear beta-(1-4)-D-glucan, while hemicelluloses include a variety of compounds, such as xylans, xyloglucans, arabinoxylans, and mannans in complex branched structures with a spectrum of substituents. Although generally polymorphous, cellulose is found in plant tissue primarily as an insoluble crystalline matrix of parallel glucan chains. Hemicelluloses usually hydrogen bond to cellulose, as well as to other hemicelluloses, which help stabilize the cell wall matrix.

Cellulose is generally found, for example, in the stems, leaves, hulls, husks, and cobs of plants or leaves, branches, and wood of trees. The cellulosic material can be, but is not limited to, agricultural residue, herbaceous material (including energy crops), municipal solid waste, pulp and paper mill residue, waste paper, and wood (including forestry residue) (see, for example, Wiselogel et al., 1995, in Handbook on Bioethanol (Charles E. Wyman, editor), pp. 105-118, Taylor & Francis, Washington D.C.; Wyman, 1994, Bioresource Technology 50: 3-16; Lynd, 1990, Applied Biochemistry and Biotechnology 24/25: 695-719; Mosier et al., 1999, Recent Progress in Bioconversion of Lignocellulosics, in Advances in Biochemical Engineering/Biotechnology, T. Scheper, managing editor, Volume 65, pp. 23-40, Springer-Verlag, New York). It is understood herein that the cellulose may be in the form of lignocellulose, a plant cell wall material containing lignin, cellulose, and hemicellulose in a mixed matrix. In one aspect, the cellulosic material is any biomass material. In another aspect, the cellulosic material is lignocellulose, which comprises cellulose, hemicelluloses, and lignin.

Coding sequence: The term "coding sequence" or "coding region" means a polynucleotide sequence, which specifies the amino acid sequence of a polypeptide. The boundaries of the coding sequence are generally determined by an open reading frame, which usually begins with the ATG start codon or alternative start codons such as GTG and TTG and ends with a stop codon such as TAA, TAG, and TGA. The coding sequence may be a sequence of genomic DNA, cDNA, a synthetic polynucleotide, and/or a recombinant polynucleotide.

Control sequences: The term "control sequences" means nucleic acid sequences necessary for expression of a polynucleotide encoding a polypeptide of the present invention. Each control sequence may be native (i.e., from the same gene) or heterologous (i.e., from a different gene) to the polynucleotide encoding the polypeptide or native or heterologous to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a polypeptide.

Disruption: The term "disruption" means that a coding region and/or control sequence of a referenced gene is partially or entirely modified (such as by deletion, insertion, and/or substitution of one or more nucleotides) resulting in the absence (inactivation) or decrease in expression, and/or the absence or decrease of enzyme activity of the encoded polypeptide. The effects of disruption can be measured using techniques known in the art such as detecting the absence or decrease of enzyme activity using from cell-free extract measurements referenced herein; or by the absence or decrease of corresponding mRNA (e.g., at least 25% decrease, at least 50% decrease, at least 60% decrease, at least 70% decrease, at least 80% decrease, or at least 90% decrease); the absence or decrease in the amount of corresponding polypeptide having enzyme activity (e.g., at least 25% decrease, at least 50% decrease, at least 60% decrease, at least 70% decrease, at least 80% decrease, or at least 90% decrease); or the absence or decrease of the specific activity of the corresponding polypeptide having enzyme activity (e.g., at least 25% decrease, at least 50% decrease, at least 60% decrease, at least 70% decrease, at least 80% decrease, or at least 90% decrease). Disruptions of a particular gene of interest can be generated by methods known in the art, e.g., by directed homologous recombination (see *Methods in Yeast Genetics* (1997 edition), Adams, Gottschling, Kaiser, and Stems, Cold Spring Harbor Press (1998)).

Endogenous gene: The term "endogenous gene" means a gene that is native to the referenced host cell. "Endogenous gene expression" means expression of an endogenous gene.

Endoglucanase: The term "endoglucanase" means an endo-1,4-(1,3;1,4)-beta-D-glucan 4-glucanohydrolase (E.C. 3.2.1.4) that catalyzes endohydrolysis of 1,4-beta-D-glycosidic linkages in cellulose, cellulose derivatives (such as carboxymethyl cellulose and hydroxyethyl cellulose), lichenin, beta-1,4 bonds in mixed beta-1,3 glucans such as cereal beta-D-glucans or xyloglucans, and other plant material containing cellulosic components.

Endoglucanase activity can be determined by measuring reduction in substrate viscosity or increase in reducing ends determined by a reducing sugar assay (Zhang et al., 2006, *Biotechnology Advances* 24: 452-481). For purposes of the present invention, endoglucanase activity is determined using carboxymethyl cellulose (CMC) as substrate according to the procedure of Ghose, 1987, *Pure and Appl. Chem.* 59: 257-268, at pH 5, 40° C.

Expression: The term "expression" includes any step involved in the production of the polypeptide including, but not limited to, transcription, post-transcriptional modification, translation, post-translational modification, and secretion. Expression can be measured—for example, to detect increased expression—by techniques known in the art, such as measuring levels of mRNA and/or translated polypeptide.

Expression vector: The term "expression vector" means a linear or circular DNA molecule that comprises a polynucleotide encoding a polypeptide and is operably linked to control sequences that provide for its expression.

Fermentable medium: The term "fermentable medium" or "fermentation medium" refers to a medium comprising one or more (e.g., two, several) sugars, such as glucose, fructose, sucrose, cellobiose, xylose, xylulose, arabinose, mannose, galactose, and/or soluble oligosaccharides, wherein the medium is capable, in part, of being converted (fermented) by a host cell into a desired product, such as ethanol. In some instances, the fermentation medium is derived from a natural source, such as sugar cane, starch, or cellulose, and may be the result of pretreating the source by enzymatic hydrolysis (saccharification). The term fermentation medium is understood herein to refer to a medium before the fermenting organism is added, such as, a medium resulting from a saccharification process, as well as a medium used in a simultaneous saccharification and fermentation process (SSF).

Fragment: The term "fragment" means a polypeptide, a catalytic domain, or a carbohydrate binding module having one or more (e.g., several) amino acids absent from the amino and/or carboxyl terminus of a mature polypeptide or domain; wherein the fragment has beta-glucanase activity (e.g., beta-1,6-glucanase activity and/or exo- and/or endo-beta-1,3-glucanase activity, or carbohydrate binding activity. In some embodiments, a fragment contains at least 350 amino acid residues (e.g., amino acids 1 to 350 of SEQ ID NO: 2 or SEQ ID NO: 3), at least 370 amino acid residues (e.g., amino acids 1 to 370 of SEQ ID NO: 2 or SEQ ID NO: 3), or at least 390 amino acid residues (e.g., amino acids 1 to 390 of SEQ ID NO: 2 or SEQ ID NO: 3). In some embodiments, a fragment contains at least 633 amino acid residues (e.g., amino acids 1 to 633 of SEQ ID NO: 5 or SEQ ID NO: 6), at least 671 amino acid residues (e.g., amino acids 1 to 671 of SEQ ID NO: 5 or SEQ ID NO: 6), or at least 707 amino acid residues (e.g., amino acids 1 to 707 of SEQ ID NO: 5 or SEQ ID NO: 6). In some embodiments, a fragment contains at least 323 amino acid residues (e.g., amino acids 1 to 323 of SEQ ID NO: 8 or SEQ ID NO: 9), at least 342 amino acid residues (e.g., amino acids 1 to 342 of SEQ ID NO: 8 or SEQ ID NO: 9), or at least 361 amino acid residues (e.g., amino acids 1 to 361 of SEQ ID NO: 8 or SEQ ID NO: 9). In some embodiments, a fragment contains at least 366 amino acid residues (e.g., amino acids 1 to 366 of SEQ ID NO: 11 or SEQ ID NO: 12), at least 388 amino acid residues (e.g., amino acids 1 to 388 of SEQ ID NO: 11 or SEQ ID NO: 12), or at least 409 amino acid residues (e.g., amino acids 1 to 409 of SEQ ID NO: 11 or SEQ ID NO: 12). In some embodiments, a fragment contains at least 365 amino acid residues (e.g., amino acids 1 to 365 of SEQ ID NO: 14 or SEQ ID NO: 15), at least 386 amino acid residues (e.g., amino acids 1 to 386 of SEQ ID NO: 14 or SEQ ID NO: 15), or at least 408 amino acid residues (e.g., amino acids 1 to 408 of SEQ ID NO: 14 or SEQ ID NO: 15). In some embodiments, a fragment contains at least 363 amino acid residues (e.g., amino acids 1 to 363 of SEQ ID NO: 17 or SEQ ID NO: 18), at least 384 amino acid residues (e.g., amino acids 1 to 384 of SEQ ID NO: 17 or SEQ ID NO: 18), or at least 406 amino acid residues (e.g., amino acids 1 to 406 of SEQ ID NO: 17 or SEQ ID NO: 18). In some embodiments, a fragment contains at least 224 amino acid residues (e.g., amino acids 1 to 224 of SEQ ID NO: 20 or SEQ ID NO: 21), at least 238 amino acid residues (e.g., amino acids 1 to 238 of SEQ ID NO: 20 or SEQ ID NO: 21), or at least 251 amino acid residues (e.g., amino acids 1 to 251 of SEQ ID NO: 20 or SEQ ID NO: 21). In some embodiments, a fragment contains at least 228 amino acid residues (e.g., amino acids 1 to 228 of SEQ ID NO: 23 or SEQ ID NO: 24), at least 241 amino acid residues (e.g., amino acids 1 to 241 of SEQ ID NO: 23 or SEQ ID NO: 24), or at least 255 amino acid residues (e.g., amino acids 1 to 255 of SEQ ID NO: 23 or SEQ ID NO: 24). In some embodiments, a fragment contains at least 226 amino acid residues (e.g., amino acids 1 to 226 of SEQ ID NO: 26 or SEQ ID NO: 27), at least 240 amino acid residues (e.g., amino acids 1 to 240 of SEQ ID NO: 26 or SEQ ID NO: 27), or at least 253 amino acid residues (e.g., amino acids 1 to 253, 7 to 260, 13 to 266 of SEQ ID NO: 26 or SEQ ID NO: 27). In some embodiments, a fragment contains at least 286 amino acid residues (e.g., amino acids 1 to 286 of SEQ ID NO: 29 or SEQ ID NO: 30), at least 303 amino acid residues (e.g., amino acids 1 to 303 of SEQ ID NO: 29 or SEQ ID NO: 30), or at least 320 amino acid residues (e.g., amino acids 1 to 320 of SEQ ID NO: 29 or SEQ ID NO: 30). In some embodiments, a fragment contains at least 417 amino acid residues (e.g., amino acids 1 to 417 of SEQ ID NO: 32 or SEQ ID NO: 33), at least 441 amino acid residues (e.g., amino acids 1 to 441 of SEQ ID NO: 32 or SEQ ID NO: 33), or at least 466 amino acid residues (e.g., amino acids 1 to 466 of SEQ ID NO: 32 or SEQ ID NO: 33). In some embodiments, a fragment contains at least 350 amino acid residues (e.g., amino acids 1 to 350 of SEQ ID NO: 35 or SEQ ID NO: 36), at least 370 amino acid residues (e.g., amino acids 1 to 370 of SEQ ID NO: 35 or SEQ ID NO: 36), or at least 390 amino acid residues (e.g., amino acids 1 to 390 of SEQ ID NO: 35 or SEQ ID NO: 36). In some embodiments, a fragment contains at least 333 amino acid residues (e.g., amino acids 1 to 333 of SEQ ID NO: 38 or SEQ ID NO: 39), at least 353 amino acid residues (e.g., amino acids 1 to 353 of SEQ ID NO: 38 or SEQ ID NO: 39), or at least 372 amino acid residues (e.g., amino acids 1 to 372 of SEQ ID NO: 38 or SEQ ID NO: 39). In some embodiments, a fragment contains at least 350 amino acid residues (e.g., amino acids 1 to 350 of SEQ ID NO: 41 or SEQ ID NO: 42), at least 370 amino acid residues (e.g., amino acids 1 to 370 of SEQ ID NO: 41 or SEQ ID NO: 42), or at least 390 amino acid residues (e.g., amino acids 1 to 390 of SEQ ID NO: 41 or SEQ ID NO: 42). In some embodiments, a fragment contains at least 280 amino acid residues (e.g., amino acids 1 to 280 of SEQ ID NO: 44 or SEQ ID NO: 45), at least 291 amino acid residues (e.g., amino acids 1 to 291 of SEQ ID NO: 44 or SEQ ID NO: 45), or at least 313 amino acid residues (e.g., amino acids 1 to 313 of SEQ ID NO: 44 or SEQ ID NO: 45). In some embodiments, a fragment contains at least 204 amino acid residues (e.g., amino acids 1 to 204 of SEQ ID NO: 47 or SEQ ID NO: 48), at least 216 amino acid residues (e.g., amino acids 1 to 216 of SEQ ID NO: 47 or SEQ ID NO: 48), or at least 228 amino acid residues (e.g., amino acids 1 to 228 of SEQ ID NO: 47 or SEQ ID NO: 48). In some embodiments, a fragment contains at least 216 amino acid residues (e.g., amino acids 1 to 216 of SEQ ID NO: 50 or SEQ ID NO: 51), at least 229 amino acid residues (e.g., amino acids 1 to 254 of SEQ ID NO: 50 or SEQ ID NO: 51), or at least 242 amino acid residues (e.g., amino acids 1 to 242 of SEQ ID NO: 50 or SEQ ID NO: 51). In some embodiments, a fragment contains at least 234 amino acid residues (e.g., amino acids 1 to 234 of SEQ ID NO: 53 or SEQ ID NO: 54), at least 248 amino acid residues (e.g., amino acids 1 to 248 of SEQ ID NO: 53 or SEQ ID NO: 54), or at least 261 amino acid residues (e.g., amino acids 1 to 261 of SEQ ID NO: 53 or SEQ ID NO: 54). In some embodiments, a fragment contains at least 224 amino acid residues (e.g., amino acids 1 to 224 of SEQ ID NO: 56 or SEQ ID NO: 57), at least 237 amino acid residues (e.g., amino acids 1 to 237 of SEQ ID NO: 56 or SEQ ID NO: 57), or at least 250 amino acid residues (e.g., amino acids 1 to 250 of SEQ ID NO: 56 or SEQ ID NO: 57). In some embodiments, a fragment contains at least 230 amino acid residues (e.g., amino acids 1 to 230 of SEQ ID NO: 59 or SEQ ID NO: 60), at least 243 amino acid residues (e.g., amino acids 1 to 243 of SEQ ID NO: 59 or SEQ ID NO: 60), or at least 257 amino acid residues (e.g., amino acids 1 to 257 of SEQ ID NO: 59 or SEQ ID NO: 60). In some embodiments, a fragment contains at least 210 amino acid residues (e.g., amino acids 1 to 210 of SEQ ID NO: 62 or SEQ ID NO: 63), at least 222 amino acid residues (e.g., amino acids 1 to 222 of SEQ ID NO: 62 or SEQ ID NO: 63), or at least 235 amino acid residues (e.g., amino acids 1 to 235 of SEQ ID NO: 62 or SEQ ID NO: 63). In some embodiments, a fragment contains at least 290 amino acid residues (e.g., amino acids 1 to 290 of SEQ ID NO: 65 or SEQ ID NO: 66), at least 307 amino acid residues (e.g., amino acids 1 to 307 of SEQ ID NO: 65 or SEQ ID NO: 66), or at least 324 amino acid residues (e.g., amino acids 1 to 324 of SEQ ID NO: 65 or SEQ ID NO: 66). In some embodiments, a fragment contains at least 250 amino acid residues (e.g., amino acids 1 to 250 of SEQ ID NO: 68 or SEQ ID NO: 69), at least 265 amino acid residues (e.g., amino acids 1 to 265 of SEQ ID NO: 68 or SEQ ID NO: 69), or at least 279 amino acid residues (e.g., amino acids 1 to 279 of SEQ ID NO: 68 or SEQ ID NO: 69). In some embodiments, a fragment contains at least 230 amino acid residues (e.g., amino acids 1 to 230 of SEQ ID NO: 71 or SEQ ID NO: 72), at least 244 amino acid residues (e.g., amino acids 1 to 244 of SEQ ID NO: 71 or SEQ ID NO: 72), or at least 257 amino acid residues (e.g., amino acids 1 to 257 of SEQ ID NO: 71 or SEQ ID NO: 72). In some embodiments, a fragment contains at least 214 amino acid residues (e.g., amino acids 1 to 214 of SEQ ID NO: 74 or SEQ ID NO: 75), at least 227 amino acid residues (e.g., amino acids 1 to 237 of SEQ ID NO:74 or SEQ ID NO: 75), or at least 239 amino acid residues (e.g., amino acids 1 to 239 of SEQ ID NO: 74 or SEQ ID NO: 75). In some embodiments, a fragment contains at least 366 amino acid residues (e.g., amino acids 1 to 366 of SEQ ID NO: 77 or SEQ ID NO: 78). In some embodiments, a fragment contains at least 388 amino acid residues (e.g., amino acids 1 to 388 of SEQ ID NO: 77 or SEQ ID NO: 78). In some embodiments, a fragment contains at least 409 amino acids residues (e.g., amino acids 1 to 409 of SEQ ID NO: 77 or SEQ ID NO: 78). In some embodiments, a fragment contains at least 414 amino acid residues (e.g., amino acids 1 to 414 of SEQ ID NO: 80 or SEQ ID NO: 81). In some embodiments, a fragment contains at least 438 amino acid residues (e.g., amino acids 1 to 438 of SEQ ID NO: 80 or SEQ ID NO: 81). In some embodiments, a fragment contains at least 462 amino acid residues (e.g., amino acids 1 to 462 of SEQ ID NO: 80 or SEQ ID NO: 81). In some embodiments, a fragment contains at least 389 amino acid residues (e.g., amino acids 1 to 389 of SEQ ID NO: 83 or SEQ ID NO: 84). In some embodiments, a fragment contains at least 412 amino acid residues (e.g., amino acids 1 to 412 of SEQ ID NO: 83 or SEQ ID NO: 84). In some embodiments, a fragment contains at least 435 amino acid residues (e.g., amino acids 1 to 435 of SEQ ID NO: 83 or SEQ ID NO: 84). In some embodiments, a fragment contains at least 243 amino acid residues (e.g., amino acids 1 to 243 of SEQ ID NO: 86 or SEQ ID NO: 87). In some embodiments, a fragment contains at least 257 amino acid residues (e.g., amino acids 1 to 257 of SEQ ID NO: 86 or SEQ ID NO: 87). In some embodiments, a fragment contains at least 271 amino acid residues (e.g., amino acids 1 to 271 of SEQ ID NO: 86 or SEQ ID NO: 87). In some embodiments, a fragment contains at least 244 amino acid residues (e.g., amino acids 1 to 244 of SEQ ID NO: 89 or SEQ ID NO: 90). In some embodiments, a fragment contains at least 258 amino acid residues (e.g., amino acids 1 to 258 of SEQ ID NO: 89 or SEQ ID NO: 90). In some embodiments, a fragment contains at least 272 amino acid residues (e.g., amino acids 1 to 272 of SEQ ID NO: 89 or SEQ ID NO: 90). In some embodiments, a fragment contains at least 351 amino acid residues (e.g., amino acids 1 to 351 of SEQ ID NO: 91 or SEQ ID NO: 92). In some embodiments, a fragment contains at least 371 amino acid residues (e.g., amino acids 1 to 371 of SEQ ID NO: 91 or SEQ ID NO: 92). In some embodiments, a fragment contains at least 392 amino acid residues (e.g., amino acids 1 to 392 of SEQ ID NO: 91 or SEQ ID NO: 92). In some embodiments, a fragment contains at least 364 amino acid residues (e.g., amino acids 1 to 364 of SEQ ID NOs: 95, 96, 98, 99, 101, 102, 104 or 105). In some embodiments, a fragment contains at least 386 amino acid residues (e.g., amino acids 1 to 386 of SEQ ID NOs: 95, 96, 98, 99, 99, 100, or 103). In some embodiments, a fragment contains at least 407 amino acid residues (e.g., amino acids 1 to 407 of SEQ ID NOs: 95, 96, 98, 99, 101, 102, 104 or 105). In some embodiments, a fragment contains at least 631 amino acid residues (e.g., amino acids 1 to 631 of SEQ ID NO: 107 or SEQ ID NO: 108). In some embodiments, a fragment contains at least 668 amino acid residues (e.g., amino acids 1 to 668 of SEQ ID NO: 107 or SEQ ID NO: 108). In some embodiments, a fragment contains at least 705 amino acid residues (e.g., amino acids 1 to 705 of SEQ ID NO: 107 or SEQ ID NO: 108). In some embodiments, a fragment contains at least 642 amino acid residues (e.g., amino acids 1 to 642 of SEQ ID NO: 110 or SEQ ID NO: 111). In some embodiments, a fragment contains at least 680 amino acid residues (e.g., amino acids 1 to 680 of SEQ ID NO: 110 or SEQ ID NO: 111). In some embodiments, a fragment contains at least 718 amino acid residues (e.g., amino acids 1 to 718 of SEQ ID NO: 110 or SEQ ID NO: 111). In some embodiments, a fragment contains at least 661 amino acid residues (e.g., amino acids 1 to 661 of SEQ ID NO: 113 or SEQ ID NO: 114). In some embodiments, a fragment contains at least 700 amino acid residues (e.g., amino acids 1 to 700 of SEQ ID NO: 113 or SEQ ID NO: 114). In some embodiments, a fragment contains at least 739 amino acid residues (e.g., amino acids 1 to 739 of SEQ ID NO: 113 or SEQ ID NO: 114). In some embodiments, a fragment contains at least 642 amino acid residues (e.g., amino acids 1 to 642 of SEQ ID NO: 116 or SEQ ID NO: 117). In some embodiments, a fragment contains at least 680 amino acid residues (e.g., amino acids 1 to 680 of SEQ ID NO: 116 or SEQ ID NO: 117). In some embodiments, a fragment contains at least 718 amino acid residues (e.g., amino acids 1 to 718 of SEQ ID NO: 116 or SEQ ID NO: 117). In some embodiments, a fragment contains at least 417 amino acid residues (e.g., amino acids 1 to 417 of SEQ ID NO: 119 or SEQ ID NO: 120). In some embodiments, a fragment contains at least 441 amino acid residues (e.g., amino acids 1 to 441 of SEQ ID NO: 119 or SEQ ID NO: 120). In some embodiments, a fragment contains at least 466 amino acid residues (e.g., amino acids 1 to 466 of SEQ ID NO: 119 or SEQ ID NO: 120).

Fusion polypeptide: The term "fusion polypeptide" is a polypeptide in which one polypeptide is fused at the N-terminus or the C-terminus of a polypeptide of the present invention. A fusion polypeptide is produced by fusing a polynucleotide encoding another polypeptide to a polynucleotide of the present invention. Techniques for producing fusion polypeptides are known in the art, and include ligating the coding sequences encoding the polypeptides so that they are in frame and that expression of the fusion polypeptide is under control of the same promoter(s) and terminator. Fusion polypeptides may also be constructed using intein technology in which fusion polypeptides are created post-translationally (Cooper et al., 1993, *EMBO J.* 12: 2575-2583; Dawson et al., 1994, *Science* 266: 776-779). A fusion polypeptide can further comprise a cleavage site between the two polypeptides. Upon secretion of the fusion protein, the site is cleaved releasing the two polypeptides. Examples of cleavage sites include, but are not limited to, the sites disclosed in Martin et al., 2003, *J. Ind. Microbiol. Biotechnol.* 3: 568-576; Svetina et al., 2000, *J. Biotechnol.* 76: 245-251; Rasmussen-Wilson et al., 1997, *Appl. Environ. Microbiol.* 63: 3488-3493; Ward et al., 1995, *Biotechnology* 13: 498-503; and Contreras et al., 1991, *Biotechnology* 9: 378-381; Eaton et al., 1986, *Biochemistry* 25: 505-512; Collins-Racie et al., 1995, *Biotechnology* 13: 982-987; Carter et al., 1989, Proteins: Structure, *Function, and Genetics* 6: 240-248; and Stevens, 2003, *Drug Discovery World* 4: 35-48.

Glucoamylase: The term "glucoamylase" (1,4-alpha-D-glucan glucohydrolase, EC 3.2.1.3) is defined as an enzyme, which catalyzes the release of D-glucose from the non-reducing ends of starch or related oligo- and polysaccharide molecules. The Glucoamylase Unit (AGU) is defined as the amount of enzyme, which hydrolyses 1 micromole maltose per minute under the standard conditions 37° C., pH 4.3, substrate: maltose 23.2 mM, buffer acetate 0.1 M, reaction time 5 minutes.

Heterologous: The term "heterologous" means, with respect to a host cell, that a polypeptide or nucleic acid does not naturally occur in the host cell. The term "heterologous" means, with respect to a polypeptide or nucleic acid, that a control sequence, e.g., promoter, or domain of a polypeptide or nucleic acid is not naturally associated with the polypeptide or nucleic acid, i.e., the control sequence is from a gene other than the gene encoding the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152.

Heterologous polynucleotide: The term "heterologous polynucleotide" is defined herein as a polynucleotide that is not native to the host cell; a native polynucleotide in which structural modifications have been made to the coding region; a native polynucleotide whose expression is quantitatively altered as a result of a manipulation of the DNA by recombinant DNA techniques, e.g., a different (foreign) promoter; or a native polynucleotide in a host cell having one or more extra copies of the polynucleotide to quantitatively alter expression. A "heterologous gene" is a gene comprising a heterologous polynucleotide.

Host cell: The term "host cell" means any cell type that is susceptible to transformation, transfection, transduction, and the like with a nucleic acid construct or expression vector comprising a polynucleotide described herein. The term "host cell" encompasses any progeny of a parent cell that is not identical to the parent cell due to mutations that occur during replication. The term "recombinant cell" is defined herein as a non-naturally occurring host cell comprising one or more (e.g., two, several) heterologous polynucleotides.

Hemicellulolytic enzyme or hemicellulase: The term "hemicellulolytic enzyme" or "hemicellulase" means one or more (e.g., several) enzymes that hydrolyze a hemicellulosic material. See, for example, Shallom and Shoham, *Current Opinion In Microbiology*, 2003, 6(3): 219-228). Hemicellulases are key components in the degradation of plant biomass. Examples of hemicellulases include, but are not limited to, an acetylmannan esterase, an acetylxylan esterase, an arabinanase, an arabinofuranosidase, a coumaric acid esterase, a feruloyl esterase, a galactosidase, a glucuronidase, a glucuronoyl esterase, a GH5 mannanase, a GH26 mannanase, a mannosidase, a xylanase, and a xylosidase. The substrates for these enzymes, hemicelluloses, are a heterogeneous group of branched and linear polysaccharides that are bound via hydrogen bonds to the cellulose microfibrils in the plant cell wall, crosslinking them into a robust network. Hemicelluloses are also covalently attached to lignin, forming together with cellulose a highly complex structure. The variable structure and organization of hemicelluloses require the concerted action of many enzymes for its complete degradation. The catalytic modules of hemicellulases are either glycoside hydrolases (GHs) that hydrolyze glycosidic bonds, or carbohydrate esterases (CEs), which hydrolyze ester linkages of acetate or ferulic acid side groups. These catalytic modules, based on homology of their primary sequence, can be assigned into GH and CE families. Some families, with an overall similar fold, can be further grouped into clans, marked alphabetically (e.g., GH-A). A most informative and updated classification of these and other carbohydrate active enzymes is available in the Carbohydrate-Active Enzymes (CAZy) database. Hemicellulolytic enzyme activities can be measured according to Ghose and Bisaria, 1987, *Pure & Appl. Chem.* 59: 1739-1752, at a suitable temperature such as 40° C.-80° C., e.g., 50° C., 55° C., 60° C., 65° C., or 70° C., and a suitable pH such as 4-9, e.g., 5.0, 5.5, 6.0, 6.5, or 7.0.

Hybrid polypeptide: The term "hybrid polypeptide" means a polypeptide comprising domains from two or more polypeptides, e.g., a binding module from one polypeptide and a catalytic domain from another polypeptide. The domains may be fused at the N-terminus or the C-terminus.

Hybridization: The term "hybridization" means the pairing of substantially complementary strands of nucleic acids, using standard Southern blotting procedures. Hybridization may be performed under medium, medium-high, high or very high stringency conditions. Medium stringency conditions means prehybridization and hybridization at 42° C. in 5×SSPE, 0.3% SDS, 200 micrograms/ml sheared and denatured salmon sperm DNA, and 35% formamide for 12 to 24 hours, followed by washing three times each for 15 minutes using 0.2×SSC, 0.2% SDS at 55° C. Medium-high stringency conditions means prehybridization and hybridization at 42° C. in 5×SSPE, 0.3% SDS, 200 micrograms/ml sheared and denatured salmon sperm DNA, and 35% formamide for 12 to 24 hours, followed by washing three times each for 15 minutes using 0.2×SSC, 0.2% SDS at 60° C. High stringency conditions means prehybridization and hybridization at 42° C. in 5×SSPE, 0.3% SDS, 200 micrograms/ml sheared and denatured salmon sperm DNA, and 50% formamide for 12 to 24 hours, followed by washing three times each for 15 minutes using 0.2×SSC, 0.2% SDS at 65° C. Very high stringency conditions means prehybridization and hybridization at 42° C. in 5×SSPE, 0.3% SDS, 200 micrograms/ml sheared and denatured salmon sperm DNA, and 50% formamide for 12 to 24 hours, followed by washing three times each for 15 minutes using 0.2×SSC, 0.2% SDS at 70° C.

Isolated: The term "isolated" means a substance in a form or environment that does not occur in nature. Non-limiting examples of isolated substances include (1) any non-naturally occurring substance, (2) any substance including, but not limited to, any enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., recombinant production in a host cell; multiple copies of a gene encoding the substance; and use of a stronger promoter than the promoter naturally associated with the gene encoding the substance). A fermentation broth produced by culturing a recombinant host cell expressing the polynucleotide of the invention will comprise the polypeptide of the invention in an isolated form.

Mature polypeptide: The term "mature polypeptide" means a polypeptide in its final form following translation and any post-translational modifications, such as N-terminal processing (e.g., removal of signal peptide), C-terminal truncation, glycosylation, phosphorylation, etc. It is known in the art that a host cell may produce a mixture of two of more different mature polypeptides (i.e., with a different C-terminal and/or N-terminal amino acid) expressed by the same polynucleotide. It is also known in the art that different host cells process polypeptides differently, and thus, one host cell expressing a polynucleotide may produce a different mature polypeptide (e.g., having a different C-terminal and/or N-terminal amino acid) as compared to another host cell expressing the same polynucleotide. In one aspect, the mature polypeptide is amino acids 18 to 429 of SEQ ID NO: 2. In one aspect, the mature polypeptide is SEQ ID NO: 3. In another aspect, the mature polypeptide is amino acids 18 to 762 of SEQ ID NO: 5. In one aspect, the mature polypeptide is SEQ ID NO: 6. In another aspect, the mature polypeptide is amino acids 1 to 380 of SEQ ID NO: 8. In one aspect, the mature polypeptide is SEQ ID NO: 9. In another aspect, the mature polypeptide is amino acids 17 to 447 of SEQ ID NO: 11. In one aspect, the mature polypeptide is SEQ ID NO: 12. In another aspect the mature polypeptide is amino acids 17 to 445 of SEQ ID NO: 14. In one aspect, the mature polypeptide is SEQ ID NO: 15. In another aspect, the mature polypeptide is amino acids 16 to 442 of SEQ ID NO: 17. In one aspect, the mature polypeptide is SEQ ID NO: 18. In another aspect, the mature polypeptide is amino acids 20 to 283 of SEQ ID NO: 20. In one aspect, the mature polypeptide is SEQ ID NO: 21. In another aspect, the mature polypeptide is amino acids 20 to 287 of SEQ ID NO: 23. In one aspect, the mature polypeptide is SEQ ID NO: 24. In another aspect the mature polypeptide is amino acids 20 to 285 of SEQ ID NO: 26. In one aspect, the mature polypeptide is SEQ ID NO: 27. In another aspect the mature polypeptide is amino acids 20 to 342 of SEQ ID NO: 29. In one aspect, the mature polypeptide is SEQ ID NO: 30. In another aspect, the mature polypeptide is amino acids 19 to 490 of SEQ ID NO: 32. In one aspect, the mature polypeptide is SEQ ID NO: 33. In another aspect, the mature polypeptide is amino acids 18 to 429 of SEQ ID NO: 35. In one aspect, the mature polypeptide is SEQ ID NO: 36. In another aspect, the mature polypeptide is amino acids 17 to 408 of SEQ ID NO: 38. In one aspect, the mature polypeptide is SEQ ID NO: 39. In another aspect, the mature polypeptide is amino acids 18 to 429 of SEQ ID NO: 41. In one aspect, the mature polypeptide is SEQ ID NO: 42. In another aspect, the mature polypeptide is amino acids 19 to 347 of SEQ ID NO: 44. In one aspect, the mature polypeptide is SEQ ID NO: 45. In another aspect, the mature polypeptide is amino acids 17 to 256 of SEQ ID NO: 47. In one aspect, the mature polypeptide is SEQ ID NO: 48. In another aspect, the mature polypeptide is amino acids 17 to 270 of SEQ ID NO: 50. In one aspect, the mature polypeptide is SEQ ID NO: 51. In another aspect, the mature polypeptide is amino acids 19 to 293 of SEQ ID NO: 53. In one aspect, the mature polypeptide is SEQ ID NO: 54. In another aspect, the mature polypeptide is amino acids 22 to 284 of SEQ ID NO: 56. In one aspect, the mature polypeptide is SEQ ID NO: 57. In another aspect, the mature polypeptide is amino acids 20 to 289 of SEQ ID NO: 59. In one aspect, the mature polypeptide is SEQ ID NO: 60. In another aspect, the mature polypeptide is amino acids 18 to 264 of SEQ ID NO: 62. In one aspect, the mature polypeptide is SEQ ID NO: 63. In another aspect, the mature polypeptide is amino acids 19 to 359 of SEQ ID NO: 65. In one aspect, the mature polypeptide is SEQ ID NO: 66. In another aspect, the mature polypeptide is amino acids 20 to 313 of SEQ ID NO: 68. In one aspect, the mature polypeptide is SEQ ID NO: 69. In another aspect, the mature polypeptide is amino acids 19 to 289 of SEQ ID NO: 71. In one aspect, the mature polypeptide is SEQ ID NO: 72. In another aspect, the mature polypeptide is amino acids 17 to 268 of SEQ ID NO: 74. In one aspect, the mature polypeptide is SEQ ID NO: 75. In another aspect, the mature polypeptide is amino acids 18 to 431 of SEQ ID NO: 77. In another aspect, the mature polypeptide is SEQ ID NO: 78. In another aspect, the mature polypeptide is amino acids 17 to 487 of SEQ ID NO: 80. In another aspect, the mature polypeptide is SEQ ID NO: 81. In another aspect, the mature polypeptide is amino acids 20 to 458 of SEQ ID NO: 83. In another aspect, the mature polypeptide is SEQ ID NO: 84. In another aspect, the mature polypeptide is amino acids 20 to 286 of SEQ ID NO: 86. In another aspect, the mature polypeptide is SEQ ID NO: 87. In another aspect, the mature polypeptide is amino acids 20 to 284 of SEQ ID NO: 89. In another aspect, the mature polypeptide is SEQ ID NO: 90. In another aspect, the mature polypeptide is amino acids 20 to 413 of SEQ ID NO: 91. In another aspect, the mature polypeptide is amino acids 18 to 429 of SEQ NO: 95. In another aspect, the mature polypeptide is SEQ ID NO: 96. In another aspect, the mature polypeptide is amino acids 18 to 429 of SEQ NO: 98. In another aspect, the mature polypeptide is SEQ ID NO: 99. In another aspect, the mature polypeptide is amino acids 18 to 429 of SEQ NO: 101. In another aspect, the mature polypeptide is SEQ ID NO: 102. In another aspect, the mature polypeptide is amino acids 18 to 429 of SEQ NO: 104. In another aspect, the mature polypeptide is SEQ ID NO: 105. In another aspect, the mature polypeptide is amino acids 34 to 743 of SEQ ID NO:

107. In another aspect, the mature polypeptide is SEQ ID NO: 108. In another aspect, the mature polypeptide is amino acids 20 to 756 of SEQ ID NO: 110. In another aspect, the mature polypeptide is amino acids 34 to 756 of SEQ ID NO: 10. In another aspect, the mature polypeptide is SEQ ID NO: 111. In another aspect, the mature polypeptide is amino acids 23 to 778 of SEQ ID NO: 113. In another aspect, the mature polypeptide is amino acids 40 to 778 of SEQ ID NO: 113. In another aspect, the mature polypeptide is SEQ ID NO: 114. In another aspect, the mature polypeptide is amino acids 17 to 756 of SEQ ID NO: 116. In another aspect, the mature polypeptide is amino acids 34 to 756 of SEQ ID NO: 116. In another aspect, the mature polypeptide is SEQ ID NO: 117. In another aspect, the mature polypeptide is amino acids 19 to 491 of SEQ ID NO: 119. In another aspect, the mature polypeptide is amino acids 77 to 491 of SEQ ID NO: 119. In another aspect, the mature polypeptide is SEQ ID NO: 120. In another aspect, the mature polypeptide is amino acids 20 to 342 of SEQ ID NO: 144. Amino acids 1 to 19 of SEQ ID NO: 144 are a signal peptide. In another aspect, the mature polypeptide is amino acids 20 to 292 of SEQ ID NO: 147. Amino acids 1 to 19 of SEQ ID NO: 147 are a signal peptide. In another aspect, the mature polypeptide is amino acids 19 to 816 of SEQ ID NO: 150. Amino acids 1 to 18 of SEQ ID NO: 150 are a signal peptide. In another aspect, the mature polypeptide is amino acids 17 to 435 of SEQ ID NO: 153. Amino acids 1 to 16 of SEQ ID NO: 153 are a signal peptide.

Mature polypeptide coding sequence: The term "mature polypeptide coding sequence" means a polynucleotide that encodes a mature polypeptide having beta-glucanase activity (e.g., beta-1,6-glucanase activity and/or exo- and/or endo-beta-1,3-glucanase activity. In one aspect, the mature polypeptide coding sequence is nucleotides 52 to 1290 of SEQ ID NO: 1. Nucleotides 1 to 51 of SEQ ID NO: 1 encode a signal peptide. In one aspect, the mature polypeptide coding sequence is nucleotides 52 to 2289 of SEQ ID NO: 4. Nucleotides 1 to 51 of SEQ ID NO: 4 encode a signal peptide. In one aspect, the mature polypeptide coding sequence is nucleotides 1 to 1143 of SEQ ID NO: 7. In one aspect, the mature polypeptide coding sequence is nucleotides 49 to 1344 of SEQ ID NO: 10. Nucleotides 1 to 48 of SEQ ID NO: 10 encode a signal peptide. In one aspect, the mature polypeptide coding sequence is nucleotides 49 to 1338 of SEQ ID NO: 13. Nucleotides 1 to 48 of SEQ ID NO: 13 encode a signal peptide. In one aspect, the mature polypeptide coding sequence is nucleotides 46 to 1329 of SEQ ID NO: 16. Nucleotides 1 to 45 of SEQ ID NO: 16 encode a signal peptide. In one aspect, the mature polypeptide coding sequence is nucleotides 58 to 771 and 830 to 910 of SEQ ID NO: 19, or the cDNA sequence thereof. Nucleotides 1 to 57 of SEQ ID NO: 19 encode a signal peptide. In one aspect, the mature polypeptide coding sequence is nucleotides 58 to 864 of SEQ ID NO: 22. Nucleotides 1 to 57 of SEQ ID NO: 22 encode a signal peptide. In one aspect, the mature polypeptide coding sequence is nucleotides 58 to 777 and 839 to 919 of SEQ ID NO: 25, or the cDNA sequence thereof. Nucleotides 1 to 57 of SEQ ID NO: 25 encode a signal peptide. In one aspect, the mature polypeptide coding sequence is nucleotides 58 to 1071 of SEQ ID NO: 28. Nucleotides 1 to 57 of SEQ ID NO: 28 encode a signal peptide. In one aspect, the mature polypeptide coding sequence is nucleotides 55 to 868 and 931 to 1535 of SEQ ID NO: 31, or the cDNA sequence thereof. Nucleotides 1 to 54 of SEQ ID NO: 31 encode a signal peptide. In one aspect, the mature polypeptide coding sequence is nucleotides 52 to 1290 of SEQ ID NO: 34. Nucleotides 1 to 51 of SEQ ID NO: 34 encode a signal peptide. In one aspect, the mature polypeptide coding sequence is nucleotides 49 to 73, 132 to 583, 645 to 914 and 998 to 1429 of SEQ ID NO: 37, or the cDNA sequence thereof. Nucleotides 1 to 48 of SEQ ID NO: 37 encode a signal peptide. In one aspect, the mature polypeptide coding sequence is nucleotides 52 to 175 and 234 to 1348 of SEQ ID NO: 40, or the cDNA sequence thereof. Nucleotides 1 to 51 of SEQ ID NO: 40 encode a signal peptide. In one aspect, the mature polypeptide coding sequence is nucleotides 55 to 145, 213 to 851 and 852 to 921 of SEQ ID NO: 43, or the cDNA sequence thereof. Nucleotides 1 to 54 of SEQ ID NO: 43 encode a signal peptide. In one aspect, the mature polypeptide coding sequence is nucleotides 49 to 109, 161 to 297, 343 to 507 and 556 to 915 of SEQ ID NO: 46, or the cDNA sequence thereof. Nucleotides 1 to 48 of SEQ ID NO: 46 encode a signal peptide. In one aspect, the mature polypeptide coding sequence is nucleotides 49 to 552, 625 to 847 and 911 to 948 of SEQ ID NO: 49, or the cDNA sequence thereof. Nucleotides 1 to 48 of SEQ ID NO: 49 encode a signal peptide. In one aspect, the mature polypeptide coding sequence is nucleotides 55 to 653 and 713 to 941 of SEQ ID NO: 52, or the cDNA sequence thereof. Nucleotides 1 to 54 of SEQ ID NO: 52 encode a signal peptide. In one aspect, the mature polypeptide coding sequence is nucleotides 64 to 435, 486 to 676 and 727 to 955 of SEQ ID NO: 55, or the cDNA sequence thereof. Nucleotides 1 to 63 of SEQ ID NO: 55 encode a signal peptide. In one aspect, the mature polypeptide coding sequence is nucleotides 58 to 453, 559 to 746 and 888 to 1116 of SEQ ID NO: 58, or the cDNA sequence thereof. Nucleotides 1 to 57 of SEQ ID NO: 58 encode a signal peptide. In one aspect, the mature polypeptide coding sequence is nucleotides 52 to 112, 183 to 319, 390 to 554 and 609 to 989 of SEQ ID NO: 61, or the cDNA sequence thereof. Nucleotides 1 to 51 of SEQ ID NO: 61 encode a signal peptide. In one aspect, the mature polypeptide coding sequence is nucleotides 55 to 784 and 839 to 1134 of SEQ ID NO: 64, or the cDNA sequence thereof. Nucleotides 1 to 54 of SEQ ID NO: 1 encode a signal peptide. In one aspect, the mature polypeptide coding sequence is nucleotides 58 to 137, 193 to 223, 28 to 610, 667 to 941 and 998 to 1165 of SEQ ID NO: 67, or the cDNA sequence thereof. Nucleotides 1 to 57 of SEQ ID NO: 67 encode a signal peptide. In one aspect, the mature polypeptide coding sequence is nucleotides 55 to 160, 213 to 262, 311 to 720, and 773 to 1022 of SEQ ID NO: 70, or the cDNA sequence thereof. Nucleotides 1 to 54 of SEQ ID NO: 70 encode a signal peptide. In one aspect, the mature polypeptide coding sequence is nucleotides 49 to 552, 691 to 913 and 996 to 1027 of SEQ ID NO: 73, or the cDNA sequence thereof. Nucleotides 1 to 48 of SEQ ID NO: 73 encode a signal peptide. In one aspect, the mature polypeptide coding sequence is nucleotides 52 to 165 and 228 to 1348 of SEQ ID NO: 76, or the cDNA sequence thereof. Nucleotides 1 to 51 of SEQ ID NO: 76 encode a signal peptide. In one aspect, the mature polypeptide coding sequence is nucleotides 49 to 862 and 919 to 1520 of SEQ ID NO: 79, or the cDNA sequence thereof. Nucleotides 1 to 48 of SEQ ID NO: 79 encode a signal peptide. In one aspect, the mature polypeptide coding sequence is nucleotides 58 to 1377 of SEQ ID NO: 82. Nucleotides 1 to 57 of SEQ ID NO: 82 encode a signal peptide. In one aspect, the mature polypeptide coding sequence is nucleotides 58 to 780 and 837 to 917 of SEQ ID NO: 85, or the cDNA sequence thereof. Nucleotides 1 to 57 of SEQ ID NO: 85 encode a signal peptide. In one aspect, the mature polypeptide coding sequence is nucleotides 58 to 771 and 830 to 913 of SEQ ID NO: 88, or the cDNA sequence thereof. Nucleotides 1 to 57 of SEQ ID NO: 88 encode a signal peptide. In one aspect, the mature polypeptide coding sequence is nucleotides 58 to 175 and 237 to 1351 of SEQ ID NO: 94, or the cDNA sequence thereof. Nucleotides 1 to 57 of SEQ ID NO: 94 encode a signal peptide. In one aspect, the mature polypeptide coding sequence is nucleotides 52 to 175 and 234 to 1348 of SEQ ID NO: 97, or the cDNA sequence thereof. Nucleotides 1 to 51 of SEQ ID NO: 97 encode a signal peptide. In one aspect, the mature polypeptide coding sequence is nucleotides 52 to 175 and 234 to 1348 of SEQ ID NO: 100, or the cDNA sequence thereof. Nucleotides 1 to 51 of SEQ ID NO: 100 encode a signal peptide. In one aspect, the mature polypeptide coding sequence is nucleotides 52 to 175 and 237 to 1351 of SEQ ID NO: 103, or the cDNA sequence thereof. Nucleotides 1 to 51 of SEQ ID NO: 103 encode a signal peptide. In one aspect, the mature polypeptide coding sequence is nucleotides 52 to 294, 349 to 2164, and 2219 to 2391 of SEQ ID NO: 106. Nucleotides 1 to 51 of SEQ ID NO: 106 encode a signal peptide. In another aspect, the mature polypeptide coding sequence is nucleotides 58 to 2101 and 2155 to 2324 of SEQ ID NO: 109. Nucleotides 1 to 57 of SEQ ID NO: 109 encode a signal peptide. In another aspect, the mature polypeptide coding sequence is nucleotides 69 to 2337 of SEQ ID NO: 112. Nucleotides 1 to 68 of SEQ ID NO: 112 encode a signal peptide. In another aspect, the mature polypeptide coding sequence is nucleotides 49 to 2101 and 2155 to 2324 of SEQ ID NO: 115. Nucleotides 1 to 48 of SEQ ID NO: 115 encode a signal peptide. In another aspect, the mature polypeptide coding sequence is nucleotides 55 to 871 and 947 to 1551 of SEQ ID NO: 118. Nucleotides 1 to 54 of SEQ ID NO: 118 encode a signal peptide. In another aspect, the mature polypeptide coding sequence is nucleotides 1 to 347 and 415 to 1096 of SEQ ID NO: 143. Nucleotides 1 to 57 encode a signal peptide. In another aspect, the mature polypeptide coding sequence is nucleotides 1 to 798 and 859 to 939 of SEQ ID NO: 146. Nucleotides 1 to 57 encode a signal peptide. In another aspect, the mature polypeptide coding sequence is nucleotides 1 to 337, 391 to 849, 905 to 2084, 2142 to 2234 and 2300 to 2681 of SEQ ID NO: 149. In another aspect, the mature polypeptide coding sequence is nucleotides 1 to 1308 of SEQ ID NO: 152. Nucleotides 1 to 48 encode a signal peptide.

Native: The term "native" means a nucleic acid or polypeptide naturally occurring in a host cell.

Nucleic acid construct: The term "nucleic acid construct" means a nucleic acid molecule, either single- or double-stranded, which is isolated from a naturally occurring gene or is modified to contain segments of nucleic acids in a manner that would not otherwise exist in nature or which is synthetic, which comprises one or more control sequences.

Operably linked: The term "operably linked" means a configuration in which a control sequence is placed at an appropriate position relative to the coding sequence of a polynucleotide such that the control sequence directs expression of the coding sequence.

Pretreated corn stover: The term "Pretreated Corn Stover" or "PCS" means a cellulosic-containing material derived from corn stover by treatment with heat and dilute sulfuric acid, alkaline pretreatment, neutral pretreatment, or any pretreatment known in the art.

Protease: The term "protease" is defined herein as an enzyme that hydrolyses peptide bonds. It includes any enzyme belonging to the EC 3.4 enzyme group (including each of the thirteen subclasses thereof). The EC number refers to Enzyme Nomenclature 1992 from NC-IUBMB, Academic Press, San Diego, California, including supplements 1-5 published in Eur. J. Biochem. 223:1-5 (1994); Eur. J. Biochem. 232:1-6 (1995); Eur. J. Biochem. 237:1-5 (1996); Eur. J. Biochem. 250: 1-6 (1997); and Eur. J. Biochem. 264: 610-650 (1999); respectively. The term "subtilases" refer to a sub-group of serine protease according to Siezen et al., 1991, Protein Engng. 4: 719-737 and Siezen et al., 1997, Protein Science 6: 501-523.

Proteases are classified on the basis of their catalytic mechanism into the following groups: Serine proteases (S), Cysteine proteases (C), Aspartic proteases (A), Metalloproteases (M), and Unknown, or as yet unclassified, proteases (U), see Handbook of Proteolytic Enzymes, A. J. Barrett, N. D. Rawlings, J. F. Woessner (eds), Academic Press (1998), in particular the general introduction part.

Polypeptides having protease activity, or proteases, are sometimes also designated peptidases, proteinases, peptide hydrolases, or proteolytic enzymes. Proteases may be of the exo-type (exopeptidases) that hydrolyse peptides starting at either end thereof, or of the endo-type that act internally in polypeptide chains (endopeptidases).

In particular embodiments, the proteases for use in the processes of the invention are selected from the group consisting of:
(a) proteases belonging to the EC 3.4.24 metalloendopeptidases;
(b) metalloproteases belonging to the M group of the above Handbook;
(c) metalloproteases not yet assigned to clans (designation: Clan MX), or belonging to either one of clans MA, MB, MC, MD, ME, MF, MG, MH (as defined at pp. 989-991 of the above Handbook);
(d) other families of metalloproteases (as defined at pp. 1448-1452 of the above Handbook);
(e) metalloproteases with a HEXXH motif;
(f) metalloproteases with an HEFTH motif;
(g) metalloproteases belonging to either one of families M3, M26, M27, M32, M34, M35, M36, M41, M43, or M47 (as defined at pp. 1448-1452 of the above Handbook); and
(h) metalloproteases belonging to family M35 (as defined at pp. 1492-1495 of the above Handbook).

Protease activity: The term "protease activity" means proteolytic activity (EC 3.4). There are several protease activity types such as trypsin-like proteases cleaving at the carboxyterminal side of Arg and Lys residues and chymotrypsin-like proteases cleaving at the carboxyterminal side of hydrophobic amino acid residues.

Protease activity can be measured using any assay, in which a substrate is employed, that includes peptide bonds relevant for the specificity of the protease in question. Assay-pH and assay-temperature are likewise to be adapted to the protease in question. Examples of assay-pH-values are pH 2, 3, 4, 5, 6, 7, 8, 9, 10, 11, or 12. Examples of assay-temperatures are 15, 20, 25, 30, 35, 37, 40, 45, 50, 55, 60, 65, 70, 80, 90, or 95° C. Examples of general protease substrates are casein, bovine serum albumin and haemoglobin. In the classical Anson and Mirsky method, denatured haemoglobin is used as substrate and after the assay incubation with the protease in question, the amount of trichloroacetic acid soluble haemoglobin is determined as a measurement of protease activity (Anson, M. L. and Mirsky, A. E., 1932, J. Gen. Physiol. 16: 59 and Anson, M. L., 1938, J. Gen. Physiol. 22: 79).

Pullulanase: The term "pullulanase" means a starch debranching enzyme having pullulan 6-glucano-hydrolase activity (EC 3.2.1.41) that catalyzes the hydrolysis the α-1,6-glycosidic bonds in pullulan, releasing maltotriose with reducing carbohydrate ends. For purposes of the present invention, pullulanase activity can be determined according to a PHADEBAS assay or the sweet potato starch assay described in WO2016/087237.

Purified: The term "purified" means a nucleic acid or polypeptide that is substantially free from other components as determined by analytical techniques well known in the art (e.g., a purified polypeptide or nucleic acid may form a discrete band in an electrophoretic gel, chromatographic eluate, and/or a media subjected to density gradient centrifugation). A purified nucleic acid or polypeptide is at least about 50% pure, usually at least about 60%, about 65%, about 70%, about 75%, about 80%, about 85%, about 90%, about 91%, about 92%, about 93%, about 94%, about 95%, about 96%, about 97%, about 98%, about 99%, about 99.5%, about 99.6%, about 99.7%, about 99.8% or more pure (e.g., percent by weight on a molar basis). In a related sense, a composition is enriched for a molecule when there is a substantial increase in the concentration of the molecule after application of a purification or enrichment technique. The term "enriched" refers to a compound, polypeptide, cell, nucleic acid, amino acid, or other specified material or component that is present in a composition at a relative or absolute concentration that is higher than a starting composition.

Recombinant: The term "recombinant," when used in reference to a cell, nucleic acid, protein or vector, means that it has been modified from its native state. Thus, for example, recombinant cells express genes that are not found within the native (non-recombinant) form of the cell, or express native genes at different levels or under different conditions than found in nature. Recombinant nucleic acids differ from a native sequence by one or more nucleotides and/or are operably linked to heterologous sequences, e.g., a heterologous promoter in an expression vector. Recombinant proteins may differ from a native sequence by one or more amino acids and/or are fused with heterologous sequences. A vector comprising a nucleic acid encoding a polypeptide is a recombinant vector. The term "recombinant" is synonymous with "genetically modified" and "transgenic".

Sequence Identity: The relatedness between two amino acid sequences or between two nucleotide sequences is described by the parameter "sequence identity". For purposes of the present invention, the sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 5.0.0 or later. The parameters used are gap open penalty of 10, gap extension penalty of 0.5, and the EBLOSUM62 (EMBOSS version of BLOSUM62) substitution matrix. The output of Needle labeled "longest identity" (obtained using the—nobrief option) is used as the percent identity and is calculated as follows:

(Identical Residues×100)/(Length of Alignment−Total Number of Gaps in Alignment)

For purposes of the present invention, the sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 5.0.0 or later. The parameters used are gap open penalty of 10, gap extension penalty of 0.5, and the EDNAFULL (EMBOSS version of NCBI NUC4.4) substitution matrix. The output of Needle labeled "longest identity" (obtained using the—nobrief option) is used as the percent identity and is calculated as follows:

(Identical Deoxyribonucleotides×100)/(Length of Alignment−Total Number of Gaps in Alignment)

Signal peptide: The term "signal peptide" is defined herein as a peptide linked (fused) in frame to the amino terminus of a polypeptide having biological activity and directs the polypeptide into the cell's secretory pathway. Signal sequences may be determined using techniques known in the art (See, e.g., Zhang and Henzel, 2004, *Protein Science* 13: 2819-2824). The polypeptides described herein may comprise any suitable signal peptide known in the art, or any signal peptide described in U.S. Provisional application No. 62/883,519, filed Aug. 6, 2019 (incorporated herein by reference).

Subsequence: The term "subsequence" means a polynucleotide having one or more (e.g., several) nucleotides absent from the 5' and/or 3' end of a mature polypeptide coding sequence; wherein the subsequence encodes a fragment having beta-glucanase activity (e.g., beta-1,6-glucanase and/or exo- and/or endo-beta-1,3-glucanase activity. In one aspect, a subsequence contains at least 1050 nucleotides (e.g., nucleotides 1 to 1050 of SEQ ID NO: 1), at least 1110 nucleotides (e.g., nucleotides 1 to 1110 of SEQ ID NO: 1), or at least 1170 nucleotides (e.g., nucleotides 1 to 1170 of SEQ ID NO: 1). In one aspect, a subsequence contains at least 1899 nucleotides (e.g., nucleotides 1 to 1899 of SEQ ID NO: 4), at least 2013 nucleotides (e.g., nucleotides 1 to 2013 of SEQ ID NO: 4), or at least 2121 nucleotides (e.g., nucleotides 1 to 2121 of SEQ ID NO: 4). In one aspect, a subsequence contains at least 969 nucleotides (e.g., nucleotides 1 to 969 of SEQ ID NO: 7), at least 1026 nucleotides (e.g., nucleotides 1 to 1026 of SEQ ID NO: 7), or at least 1083 nucleotides (e.g., nucleotides 1 to 1083 of SEQ ID NO: 7). In one aspect, a subsequence contains at least 1098 nucleotides (e.g., nucleotides 1 to 1098 of SEQ ID NO: 10), at least 1164 nucleotides (e.g., nucleotides 1 to 1164 of SEQ ID NO: 10), or at least 1227 nucleotides (e.g., nucleotides 1 to 1227 of SEQ ID NO: 10). In one aspect, a subsequence contains at least 1095 nucleotides (e.g., nucleotides 1 to 1095 of SEQ ID NO: 13), at least 1158 nucleotides (e.g., nucleotides 1 to 1158 of SEQ ID NO: 13), or at least 1224 nucleotides (e.g., nucleotides 1 to 1224 of SEQ ID NO: 13). In one aspect, a subsequence contains at least 1089 nucleotides (e.g., nucleotides 1 to 1089 of SEQ ID NO: 16), at least 1152 nucleotides (e.g., nucleotides 1 to 1152 of SEQ ID NO: 16), or at least 1218 nucleotides (e.g., nucleotides 1 to 1218 of SEQ ID NO: 16). In one aspect, a subsequence contains at least 672 nucleotides (e.g., nucleotides 1 to 672 of SEQ ID NO: 19), at least 714 nucleotides (e.g., nucleotides 1 to 714 of SEQ ID NO: 19), or at least 753 nucleotides (e.g., nucleotides 1 to 753 of SEQ ID NO: 19). In one aspect, a subsequence contains at least 684 nucleotides (e.g., nucleotides 1 to 684 of SEQ ID NO: 22), at least 723 nucleotides (e.g., nucleotides 1 to 723 SEQ ID NO: 22), or at least 765 nucleotides (e.g., nucleotides 1 to 765 of SEQ ID NO: 22). In one aspect, a subsequence contains at least 720 nucleotides (e.g., nucleotides 1 to 720 of SEQ ID NO: 25), at least 723 nucleotides (e.g., nucleotides 1 to 723 of SEQ ID NO: 25), or at least 759 nucleotides (e.g., nucleotides 1 to 759 of SEQ ID NO: 25). In one aspect, a subsequence contains at least 858 nucleotides (e.g., nucleotides 1 to 858 of SEQ ID NO: 28), at least 909 nucleotides (e.g., nucleotides 1 to 909 of SEQ ID NO: 28), or at least 960 nucleotides (e.g., nucleotides 1 to 960 of SEQ ID NO: 28). In one aspect, a subsequence contains at least 1251 nucleotides (e.g., nucleotides 1 to 1251 of SEQ ID NO: 31), at least 1323 nucleotides (e.g., nucleotides 1 to 1323 of SEQ ID NO: 31), or at least 1398 nucleotides (e.g., nucleotides 1 to 1398 of SEQ ID NO: 31). In one aspect, a subsequence contains at least 1050 nucleotides (e.g., nucleotides 1 to 1050 of SEQ ID NO: 34), at least 1110 nucleotides (e.g., nucleotides 1 to 1110 of SEQ ID NO: 34), or at least 1170 nucleotides (e.g., nucleotides 1 to 1170 of SEQ ID NO: 34). In one aspect, a subsequence contains at least 999 nucleotides (e.g., nucleotides 1 to 999 of SEQ ID NO: 37), at least 1059 nucleotides (e.g., nucleotides 1 to 1059 of SEQ ID NO: 37), or at least 1116 nucleotides (e.g., nucleotides 1 to 1116 of SEQ ID NO: 37). In one aspect, a subsequence contains at least 1050 nucleotides (e.g., nucleotides 1 to 1050 of SEQ ID NO: 40), at least 1110 nucleotides (e.g., nucleotides 1 to 1110 of SEQ ID NO: 40), or at least 1170 nucleotides (e.g., nucleotides 1 to 1170 of SEQ ID NO: 40). In one aspect, a subsequence contains at least 840 nucleotides (e.g., nucleotides 1 to 840 of SEQ ID NO: 43, or the cDNA thereof), at least 873 nucleotides (e.g., nucleotides 1 to 873 of SEQ ID NO: 43, or the cDNA thereof), or at least 939 nucleotides (e.g., nucleotides 1 to 939 of SEQ ID NO: 43, or the cDNA thereof). In one aspect, a subsequence contains at least 612 nucleotides (e.g., nucleotides 1 to 612 of SEQ ID NO: 46, or the cDNA thereof), at least 648 nucleotides (e.g., nucleotides 1 to 648 of SEQ ID NO: 46, or the cDNA thereof), or at least 672 nucleotides (e.g., nucleotides 1 to 672 of SEQ ID NO: 46, or the cDNA thereof). In one aspect, a subsequence contains at least 648 nucleotides (e.g., nucleotides 1 to 648 of SEQ ID NO: 49, or the cDNA thereof), at least 687 nucleotides (e.g., nucleotides 1 to 687 of SEQ ID NO: 49, or the cDNA thereof), or at least 726 nucleotides (e.g., nucleotides 1 to 726 of SEQ ID NO: 49, or the cDNA thereof). In one aspect, a subsequence contains at least 702 nucleotides (e.g., nucleotides 1 to 702 of SEQ ID NO: 52, or the cDNA thereof), at least 744 nucleotides (e.g., nucleotides 1 to 744 of SEQ ID NO: 52, or the cDNA thereof), or at least 783 nucleotides (e.g., nucleotides 1 to 783 of SEQ ID NO: 52, or the cDNA thereof). In one aspect, a subsequence contains at least 672 nucleotides (e.g., nucleotides 1 to 672 of SEQ ID NO: 55, or the cDNA thereof), at least 711 nucleotides (e.g., nucleotides 1 to 711 of SEQ ID NO: 55, or the cDNA thereof), or at least 750 nucleotides (e.g., nucleotides 1 to 750 of SEQ ID NO: 55, or the cDNA thereof). In one aspect, a subsequence contains at least 690 nucleotides (e.g., nucleotides 1 to 690 of SEQ ID NO: 58, or the cDNA thereof), at least 729 nucleotides (e.g., nucleotides 1 to 729 of SEQ ID NO: 58, or the cDNA thereof), or at least 771 nucleotides (e.g., nucleotides 1 to 771 of SEQ ID NO: 58, or the cDNA thereof). In one aspect, a subsequence contains at least 630 nucleotides (e.g., nucleotides 1 to 630 of SEQ ID NO: 61, or the cDNA thereof), at least 666 nucleotides (e.g., nucleotides 1 to 666 of SEQ ID NO: 61, or the cDNA thereof), or at least 705 nucleotides (e.g., nucleotides 1 to 705 of SEQ ID NO: 61, or the cDNA thereof). In one aspect, a subsequence contains at least 870 nucleotides (e.g., nucleotides 1 to 870 of SEQ ID NO: 64, or the cDNA thereof), at least 921 nucleotides (e.g., nucleotides 1 to 921 of SEQ ID NO: 64, or the cDNA thereof), or at least 972 nucleotides (e.g., nucleotides 1 to 972 of SEQ ID NO: 64, or the cDNA thereof). In one aspect, a subsequence contains at least 750 nucleotides (e.g., nucleotides 1 to 750 of SEQ ID NO: 67, or the cDNA thereof), at least 795 nucleotides (e.g., nucleotides 1 to 795 of SEQ ID NO: 67, or the cDNA thereof), or at least 837 nucleotides (e.g., nucleotides 1 to 837 of SEQ ID NO: 67, or the cDNA thereof). In one aspect, a subsequence contains at least 954 nucleotides (e.g., nucleotides 1 to 954 of SEQ ID NO: 70, or the cDNA thereof), at least 1010 nucleotides (e.g., nucleotides 1 to 1010 of SEQ ID NO: 70, or the cDNA thereof), or at least 1066 nucleotides (e.g., nucleotides 1 to 1066 of SEQ ID NO: 70, or the cDNA thereof). In one aspect, a subsequence contains at least 873 nucleotides (e.g., nucleotides 1 to 642 of SEQ ID NO: 73, or the cDNA thereof), at least 924 nucleotides (e.g., nucleotides 1 to 924 of SEQ ID NO: 73, or the cDNA thereof), or at least 974 nucleotides (e.g., nucleotides 1 to 974 of SEQ ID NO: 73, or the cDNA thereof). In some embodiments, a subsequence contains at least 1098 nucleotides (e.g., nucleotides 1 to 1098 of SEQ ID NO: 76, or the cDNA thereof). In some embodiments, a subsequence contains at least 1164 nucleotides (e.g., nucleotides 1 to 1164 of SEQ ID NO: 76, or the cDNA thereof). In some embodiments, a subsequence contains at least 1227 nucleotides (e.g., nucleotides 1 to 1227 of SEQ ID NO: 76, or the cDNA sequence thereof). In some embodiments, a subsequence contains at least 1242 nucleotides (e.g., nucleotides 1 to 1242 of SEQ ID NO: 79, or the cDNA thereof). In some embodiments, a subsequence contains at least 1314 nucleotides (e.g., nucleotides 1 to 1314 of SEQ ID NO: 79, or the cDNA thereof). In some embodiments, a subsequence contains at least 1386 nucleotides (e.g., nucleotides 1 to 1386 of SEQ ID NO: 79, or the cDNA thereof). In some embodiments, a subsequence contains at least 1167 nucleotides (e.g., nucleotides 1 to 1167 of SEQ ID NO: 82). In some embodiments, a subsequence contains at least 1236 nucleotides (e.g., nucleotides 1 to 1236 of SEQ ID NO: 82). In some embodiments, a subsequence contains at least 435 nucleotides (e.g., nucleotides 1 to 1236 of SEQ ID NO: 82). In some embodiments, a subsequence contains at least 729 nucleotides (e.g., nucleotides 1 to 729 of SEQ ID NO: 85, or the cDNA thereof). In some embodiments, a subsequence contains at least 771 nucleotides (e.g., nucleotides 1 to 771 of SEQ ID NO: 85, or the cDNA thereof). In some embodiments, a subsequence contains at least 813 nucleotides (e.g., nucleotides 1 to 813 of SEQ ID NO: 85, or the cDNA thereof). In some embodiments, a subsequence contains at least 732 nucleotides (e.g., nucleotides 1 to 732 of SEQ ID NO: 88, or the cDNA thereof). In some embodiments, a subsequence contains at least 774 nucleotides (e.g., nucleotides 1 to 774 of SEQ ID NO: 88, or the cDNA thereof). In some embodiments, a subsequence contains at least 816 nucleotides (e.g., nucleotides 1 to 816 of SEQ ID NO: 88, or the cDNA thereof). In some embodiments, a subsequence contains at least 1092 nucleotides (e.g., nucleotides 1 to 1092 of SEQ ID NOs: 94, 97, 100, or 103, or the cDNA sequences thereof). In some embodiments, a subsequence contains at least 1158 nucleotides (e.g., nucleotides 1 to 1158 of SEQ ID NOs: 94, 97, 100, or 103, or the cDNA sequences thereof). In some embodiments, a subsequence contains at least 1221 nucleotides (e.g., nucleotides 1 to 1221 of SEQ ID NOs: 94, 97, 100, or 103, or the cDNA sequences thereof). In some embodiments, a subsequence contains at least 1893 nucleotides (e.g., nucleotides 1 to 1893 of SEQ ID NO: 106). In some embodiments, a subsequence contains at least 2004 nucleotides (e.g., nucleotides 1 to 2004 of SEQ ID NO: 106). In some embodiments, a subsequence contains at least 2115 nucleotides (e.g., nucleotides 1 to 2115 of SEQ ID NO: 106). In some embodiments, a subsequence contains at least 1926 nucleotides (e.g., nucleotides 1 to 1926 of SEQ ID NO: 109). In some embodiments, a subsequence contains at least 2040 nucleotides (e.g., nucleotides 1 to 2040 of SEQ ID NO: 109). In some embodiments, a subsequence contains at least 2154 nucleotides (e.g., nucleotides 1 to 2154 of SEQ ID NO: 109). In some embodiments, a subsequence contains at least 1983 nucleotides (e.g., nucleotides 1 to 1983 of SEQ ID NO: 112). In some embodiments, a subsequence contains at least 2100 nucleotides (e.g., nucleotides 1 to 2100 of SEQ ID NO: 112). In some embodiments, a subsequence contains at least 2217 nucleotides (e.g., nucleotides 1 to 2217 of SEQ ID NO: 112). In some embodiments, a subsequence contains at least 1926 nucleotides (e.g., nucleotides 1 to 1926 of SEQ ID NO: 115). In some embodiments, a subsequence contains at least 2040 nucleotides (e.g., nucleotides 1 to 2040 of SEQ ID NO: 115). In some embodiments, a subsequence contains at least 2154 nucleotides (e.g., nucleotides 1 to 2154 of SEQ ID NO: 115). In some embodiments, a subsequence contains at least 1251 nucleotides (e.g., nucleotides 1 to 1251 of SEQ ID NO: 118). In some embodiments, a subsequence contains at least 1251 nucleotides (e.g., nucleotides 1 to 1251 of SEQ ID NO: 118). In some embodiments, a subsequence contains at least 1398 nucleotides (e.g., nucleotides 1 to 1398 of SEQ ID NO: 118).

Trehalase: The term "trehalase" means an enzyme which degrades trehalose into its unit monosaccharides (i.e., glucose). Trehalases are classified in EC 3.2.1.28 (alpha,alpha-trehalase) and EC. 3.2.1.93 (alpha,alpha-phosphotrehalase). The EC classes are based on recommendations of the Nomenclature Committee of the International Union of Biochemistry and Molecular Biology (IUBMB). Description of EC classes can be found on the internet, e.g., on "http://www.expasy.org/enzyme/". Trehalases are enzymes that catalyze the following reactions:
EC 3.2.1.28:
Alpha,alpha-trehalose+$H_2O \Leftrightarrow$ 2 D-glucose;
EC 3.2.1. 93:
Alpha,alpha-trehalose 6-phosphate+$H_2O \Leftrightarrow$ D-glucose+D-glucose 6-phosphate.

For purposes of the present invention, trehalase activity may be determined according to the trehalase assay procedure described below.
Principle:
Trehalose+$H_2O \xrightarrow{Trehalase}$ 2 Glucose
T=37° C., pH=5.7, A340 nm, Light path=1 cm
Spectrophotometric Stop Rate Determination
Unit Definition
One unit will convert 1.0 mmole of trehalose to 2.0 mmoles of glucose per minute at pH 5.7 at 37° C. (liberated glucose determined at pH 7.5).
(See Dahlqvist, A. (1968) Analytical Biochemistry 22, 99-107)

Variant: The term "variant" means a polypeptide having beta-glucanase activity (e.g., beta-1,6-glucanase and/or exo- and/or -endo beta-1,3-glucanase activity) comprising a man-made mutation, i.e., a substitution, insertion, and/or deletion (e.g., truncation), at one or more (e.g., several) positions. A substitution means replacement of the amino acid occupying a position with a different amino acid; a deletion means removal of the amino acid occupying a position; and an insertion means adding an amino acid adjacent to and immediately following the amino acid occupying a position. In some embodiments, insertion means adding one or more (e.g., several) amino acids, e.g., 1-5 amino acids, adjacent to the amino acid occupying a position). The variants of the present invention have at least 20%, e.g., at least 40%, at least 50%, at least 60%, at least 70%, at least 80%, at least 90%, at least 95%, or at least 100% of the beta-glucanase activity of the polypeptide of sequence selected from the group consisting of: SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, or the mature polypeptide of a sequence of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153.

Wild-type: The term "wild-type" in reference to an amino acid sequence or nucleic acid sequence means that the amino acid sequence or nucleic acid sequence is a native or naturally-occurring sequence. As used herein, the term "naturally-occurring" refers to anything (e.g., proteins, amino acids, or nucleic acid sequences) that is found in nature. Conversely, the term "non-naturally occurring" refers to anything that is not found in nature (e.g., recombinant nucleic acids and protein sequences produced in the laboratory or modification of the wild-type sequence). The term "wild-type" beta-glucanase means a beta-glucanase expressed by a naturally occurring microorganism, such as a bacterium, yeast, or filamentous fungus found in nature.

Xylanase: The term "xylanase" means a 1,4-beta-D-xylan-xylohydrolase (E.C. 3.2.1.8) that catalyzes the endohydrolysis of 1,4-beta-D-xylosidic linkages in xylans. Xylanase activity can be determined with 0.2% AZCL-arabinoxylan as substrate in 0.01% TRITON® X-100 and 200 mM sodium phosphate pH 6 at 37° C. One unit of xylanase activity is defined as 1.0 µmole of azurine produced per minute at 37° C., pH 6 from 0.2% AZCL-arabinoxylan as substrate in 200 mM sodium phosphate pH 6.

Reference to "about" a value or parameter herein includes embodiments that are directed to that value or parameter per se. For example, description referring to "about X" includes the embodiment "X". When used in combination with measured values, "about" includes a range that encompasses at least the uncertainty associated with the method of measuring the particular value, and can include a range of plus or minus two standard deviations around the stated value.

Likewise, reference to a gene or polypeptide that is "derived from" another gene or polypeptide X, includes the gene or polypeptide X.

As used herein and in the appended claims, the singular forms "a," "or," and "the" include plural referents unless the context clearly dictates otherwise.

It is understood that the embodiments described herein include "consisting" and/or "consisting essentially of" embodiments. As used herein, except where the context requires otherwise due to express language or necessary implication, the word "comprise" or variations such as "comprises" or "comprising" is used in an inclusive sense, i.e. to specify the presence of the stated features but not to preclude the presence or addition of further features in various embodiments.

DETAILED DESCRIPTION OF THE INVENTION

Polypeptides Having Beta-Glucanase Activity

In some embodiments, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99%, but less than 100% identity to the mature polypeptide of SEQ ID NO: 2, which have beta-1,3-glucanase activity. In an aspect, the polypeptides differ by up to 10 amino acids, e.g., 1, 2, 3, 4, 5, 6, 7, 8, 9, or 10, from the mature polypeptide of SEQ ID NO: 2. The polypeptide preferably comprises, consists of, or consists essentially of the amino acid sequence of SEQ ID NO: 2 or the mature polypeptide thereof; or is a fragment thereof having beta-1,3-glucanase activity. In one aspect, the mature polypeptide is SEQ ID NO: 3.

In some embodiments, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99%, but less than 100% identity to the mature polypeptide of SEQ ID NO: 5, which have beta-1,3-glucanase activity. In an aspect, the polypeptides differ by up to 10 amino acids, e.g., 1, 2, 3, 4, 5, 6, 7, 8, 9, or 10, from the mature polypeptide of SEQ ID NO: 5. The polypeptide preferably comprises, consists of, or consists essentially of the amino acid sequence of SEQ ID NO: 5 or the mature polypeptide thereof; or is a fragment thereof having beta-1,3-glucanase activity. In one aspect, the mature polypeptide is SEQ ID NO: 6.

In some embodiments, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% or 100% identity to the mature polypeptide of SEQ ID NO: 8, which have beta-1,3-glucanase activity. In an aspect, the polypeptides differ by up to 10 amino acids, e.g., 1, 2, 3, 4, 5, 6, 7, 8, 9, or 10, from the mature polypeptide of SEQ ID NO: 8. The polypeptide preferably comprises, consists of, or consists essentially of the amino acid sequence of SEQ ID NO: 8 or the mature polypeptide thereof; or is a fragment thereof having beta-1,3-glucanase activity. In one aspect, the mature polypeptide is SEQ ID NO: 9.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 11, which have beta-1,3-glucanase activity. In an aspect, the polypeptides differ by up to 10 amino acids, e.g., 1, 2, 3, 4, 5, 6, 7, 8, 9, or 10, from the mature polypeptide of SEQ ID NO: 11. The polypeptide preferably comprises, consists of, or consists essentially of the amino acid sequence of SEQ ID NO: 11 or the mature polypeptide thereof, or is a fragment thereof having beta-1,3-glucanase activity. In one aspect, the mature polypeptide is amino acids 17 to 447 of SEQ ID NO: 11. In another aspect, the mature polypeptide is SEQ ID NO: 12.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 14, which have beta-1,3-glucanase activity. In an embodiment, the polypeptides differ by up to 10 amino acids, e.g., 1, 2, 3, 4, 5, 6, 7, 8, 9, or 10, from the mature polypeptide of SEQ ID NO: 14. The polypeptide preferably comprises, consists of, or consists essentially of the amino acid sequence of SEQ ID NO: 14 or the mature polypeptide thereof, or is a fragment thereof having beta-1,3-glucanase activity. In one aspect, the mature polypeptide is amino acids 17 to 445 of SEQ ID NO: 14. In another aspect, the mature polypeptide is SEQ ID NO: 15.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 17, which have beta-1,3-glucanase activity. In an embodiment, the polypeptides differ by up to 10 amino acids, e.g., 1, 2, 3, 4, 5, 6, 7, 8, 9, or 10, from the mature polypeptide of SEQ ID NO: 17. The polypeptide preferably comprises, consists of, or consists essentially of the amino acid sequence of SEQ ID NO: 17 or the mature polypeptide thereof, or is a fragment thereof having beta-1,3-glucanase activity. In one aspect, the mature polypeptide is amino acids 16 to 442 of SEQ ID NO: 17. In another aspect, the mature polypeptide is SEQ ID NO: 18.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 20, which have beta-1,3-glucanase activity. In an embodiment, the polypeptides differ by up to 10 amino acids, e.g., 1, 2, 3, 4, 5, 6, 7, 8, 9, or 10, from the mature polypeptide of SEQ ID NO: 20. The polypeptide preferably comprises, consists of, or consists essentially of the amino acid sequence of SEQ ID NO: 7 or the mature polypeptide thereof, or is a fragment thereof having beta-1,3-glucanase activity. In one aspect, the mature polypeptide is amino acids 20 to 283 of SEQ ID NO: 20. In another aspect, the mature polypeptide is SEQ ID NO: 21.

In an embodiment, the present invention relates to isolated or purified polypeptides having a sequence identity of at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 23, which have beta-1,3-glucanase activity. In an embodiment, the polypeptides differ by up to 10 amino acids, e.g., 1, 2, 3, 4, 5, 6, 7, 8, 9, or 10, from the mature polypeptide of SEQ ID NO: 23. The polypeptide preferably comprises, consists of, or consists essentially of the amino acid sequence of SEQ ID NO: 23 or the mature polypeptide thereof, or is a fragment thereof having beta-1,3-glucanase activity. In one aspect, the mature polypeptide is amino acids 20 to 287 of SEQ ID NO: 23. In another aspect, the mature polypeptide is SEQ ID NO: 24.

In an embodiment, the present invention relates to isolated or purified polypeptides having a sequence identity of at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 26, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 26. The polypeptide preferably comprises, consists of, or consists essentially of the amino acid sequence of SEQ ID NO: 26 or the mature polypeptide thereof, or is a fragment thereof having beta-1,3-glucanase activity. In one aspect, the mature polypeptide is amino acids 20 to 285 of SEQ ID NO: 26. In another aspect, the mature polypeptide is SEQ ID NO: 27.

In an embodiment, the present invention relates to isolated or purified polypeptides having a sequence identity of at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of SEQ ID NO: 29, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 29. The polypeptide preferably comprises, consists of, or consists essentially of the amino acid sequence of SEQ ID NO: 29 or the mature polypeptide thereof, or is a fragment thereof having beta-1,3-glucanase activity. In one aspect, the mature polypeptide is amino acids 20 to 342 of SEQ ID NO: 29. In another aspect, the mature polypeptide is SEQ ID NO: 30.

In an embodiment, the present invention relates to isolated or purified polypeptides having a sequence identity of at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of SEQ ID NO: 32, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 32. The polypeptide preferably comprises, consists of, or consists essentially of the amino acid sequence of SEQ ID NO: 32 or the mature polypeptide thereof, or is a fragment thereof having beta-1,3-glucanase activity. In one aspect, the mature polypeptide is amino acids 19 to 490 of SEQ ID NO: 32. In another aspect, the mature polypeptide is SEQ ID NO: 33.

In an embodiment, the present invention relates to isolated or purified polypeptides having a sequence identity of at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 35, which beta-1,6-glucanase activity. In an embodiment, the polypeptides differ by up to 10 amino acids, e.g., 1, 2, 3, 4, 5, 6, 7, 8, 9, or 10, from the mature polypeptide of SEQ ID NO: 35. The polypeptide preferably comprises, consists of, or consists essentially of the amino acid sequence of SEQ ID NO: 35 or the mature polypeptide thereof, or is a fragment thereof having beta-1,6-glucanase activity. In one aspect, the mature polypeptide is amino acids 18 to 429 of SEQ ID NO: 35. In another aspect, the mature polypeptide is SEQ ID NO: 36.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 38, which have beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 38. In an embodiment, the polypeptide having beta-glucanase activity comprises, consists of, or consists essentially of the mature polypeptide of SEQ ID NO: 38. In one aspect, the mature polypeptide is amino acids 17 to 408 of SEQ ID NO: 38. In another aspect, the mature polypeptide is SEQ ID NO: 39.

In an embodiment, the present invention relates to isolated or purified polypeptides having a sequence identity of at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 41, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 41. The polypeptide preferably comprises, consists of, or consists essentially of the mature polypeptide of SEQ ID NO: 41 or the mature polypeptide thereof, or is a fragment thereof having beta-1,6-glucanase activity. In one aspect, the mature polypeptide is amino acids 18 to 429 of SEQ ID NO: 41. In another aspect, the mature polypeptide is SEQ ID NO: 42.

In an embodiment, the present invention relates to isolated or purified polypeptides having a sequence identity of at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or at least 99.8% identity, but less than 100% identity, to the mature polypeptide of SEQ ID NO: 44, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 44. The polypeptide preferably comprises, consists of, or consists essentially of the amino acid sequence of SEQ ID NO: 44 or the mature polypeptide thereof, or is a fragment thereof having beta-1,3-glucanase activity. In one aspect, the mature polypeptide is amino acids 19 to 347 of SEQ ID NO: 44. In another aspect, the mature polypeptide is SEQ ID NO: 45.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 47, which have beta-1,3-glucanase activity and/or beta-1,6-glucanase activity. In an embodiment, the polypeptides differ by up to 10 amino acids, e.g., 1, 2, 3, 4, 5, 6, 7, 8, 9, or 10, from the mature polypeptide of SEQ ID NO: 47. The polypeptide preferably comprises, consists of, or consists essentially of the mature polypeptide of SEQ ID NO: 47 or the mature polypeptide thereof, or is a fragment thereof having beta-1,3-glucanase activity and/or beta-1,6-glucanase activity. In one aspect, the mature polypeptide is amino acids 17 to 256 of SEQ ID NO: 47. In another aspect, the mature polypeptide is SEQ ID NO: 48.

In an embodiment, the present invention relates to isolated or purified polypeptides having a sequence identity of at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 50, which have beta-1,3-glucanase activity and/or beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 50. The polypeptide preferably comprises, consists of, or consists essentially of the mature polypeptide of SEQ ID NO: 50 or the mature polypeptide thereof, or is a fragment thereof having beta-1,3-glucanase activity and/or beta-1,6-glucanase activity. In one aspect, the mature polypeptide is amino acids 17 to 270 of SEQ ID NO: 50. In another aspect, the mature polypeptide is SEQ ID NO: 51.

In an embodiment, the present invention relates to isolated or purified polypeptides having a sequence identity of at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 53, which have beta-1,3-glucanase activity and/or beta-1,6-glucanase activity. In an embodiment, the polypeptides differ by up to 10 amino acids, e.g., 1, 2, 3, 4, 5, 6, 7, 8, 9, or 10, from the mature polypeptide of SEQ ID NO: 53.

The polypeptide preferably comprises, consists of, or consists essentially of the mature polypeptide of SEQ ID NO: 53 or the mature polypeptide thereof, or is a fragment thereof having beta-1,3-glucanase activity and/or beta-1,6-glucanase activity. In one aspect, the mature polypeptide is amino acids 1 to 18 of SEQ ID NO: 53. In another aspect, the mature polypeptide is SEQ ID NO: 54.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 56, which have beta-1,3-glucanase activity and/or beta-1,6-glucanase activity. In an embodiment, the polypeptides differ by up to 10 amino acids, e.g., 1, 2, 3, 4, 5, 6, 7, 8, 9, or 10, from the mature polypeptide of SEQ ID NO: 56. The polypeptide preferably comprises, consists of, or consists essentially of the mature polypeptide of SEQ ID NO: 56 or the mature polypeptide thereof, or is a fragment thereof having beta-1,3-glucanase activity and/or beta-1,6-glucanase activity. In one aspect, the mature polypeptide is amino acids 22 to 284 of SEQ ID NO: 56. In another aspect, the mature polypeptide is SEQ ID NO: 57.

In an embodiment, the present invention relates to isolated or purified polypeptides having a sequence identity of at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 59, which have beta-1,3-glucanase activity and/or beta-1,6-glucanase activity. In an embodiment, the polypeptides differ by up to 10 amino acids, e.g., 1, 2, 3, 4, 5, 6, 7, 8, 9, or 10, from the mature polypeptide of SEQ ID NO: 59. The polypeptide preferably comprises, consists of, or consists essentially of the mature polypeptide of SEQ ID NO: 59 or the mature polypeptide thereof, or is a fragment thereof having beta-1,3-glucanase activity and/or beta-1,6-glucanase activity. In one aspect, the mature polypeptide is amino acids 20 to 289 of SEQ ID NO: 59. In another aspect, the mature polypeptide is SEQ ID NO: 60.

In an embodiment, the present invention relates to isolated or purified polypeptides having a sequence identity of at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 62, which have beta-1,3-glucanase activity and/or beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 62. The polypeptide preferably comprises, consists of, or consists essentially of the mature polypeptide of SEQ ID NO: 62 or the mature polypeptide thereof, or is a fragment thereof having beta-1,3-glucanase activity and/or beta-1,6-glucanase activity. In one aspect, the mature polypeptide is amino acids 18 to 264 of SEQ ID NO: 62. In another aspect, the mature polypeptide is SEQ ID NO: 63.

In an embodiment, the present invention relates to isolated or purified polypeptides having a sequence identity of at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 65, which have beta-1,3-glucanase activity and/or beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 65.

The polypeptide preferably comprises, consists of, or consists essentially of the mature polypeptide of SEQ ID NO: 65 or the mature polypeptide thereof, or is a fragment thereof having beta-1,3-glucanase activity and/or beta-1,6-glucanase activity. In one aspect, the mature polypeptide is amino acids 19 to 359 of SEQ ID NO: 65. In another aspect, the mature polypeptide is SEQ ID NO: 66.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 68, which have beta-1,3-glucanase activity and/or beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 68. The polypeptide preferably comprises, consists of, or consists essentially of the mature polypeptide of SEQ ID NO: 68 or the mature polypeptide thereof, or is a fragment thereof having beta-1,3-glucanase activity and/or beta-1,6-glucanase activity. In one aspect, the mature polypeptide is amino acids 20 to 313 of SEQ ID NO: 68. In another aspect, the mature polypeptide is SEQ ID NO: 69.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 71, which have beta-1,3-glucanase activity and/or beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 71. The polypeptide preferably comprises, consists of, or consists essentially of the mature polypeptide of SEQ ID NO: 71 or the mature polypeptide thereof, or is a fragment thereof having beta-1,3-glucanase activity and/or beta-1,6-glucanase activity. In one aspect, the mature polypeptide is amino acids 19 to 289 of SEQ ID NO: 71. In another aspect, the mature polypeptide is SEQ ID NO: 72.

In an embodiment, the present invention relates to isolated or purified polypeptides having a sequence identity of at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 74, which have beta-1,3-glucanase activity and/or beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 74. The polypeptide preferably comprises, consists of, or consists essentially of the mature polypeptide of SEQ ID NO: 74 or the mature polypeptide thereof, or is a fragment thereof having beta-1,3-glucanase activity and/or beta-1,6-glucanase activity. In one aspect, the mature polypeptide is amino acids 17 to 268 of SEQ ID NO: 74. In another aspect, the mature polypeptide is SEQ ID NO: 75.

In an embodiment, the present invention relates to isolated or purified polypeptides having a sequence identity of at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 77, which have beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 77. The polypeptide preferably comprises, consists of, or consists essentially of the mature polypeptide of SEQ ID NO: 77 or the mature polypeptide thereof, or is a fragment thereof having beta-1,6-glucanase activity. In one aspect, the mature polypeptide is amino acids 18 to 431 of SEQ ID NO: 77. In another aspect, the mature polypeptide is SEQ ID NO: 78.

In an embodiment, the present invention relates to isolated or purified polypeptides having a sequence identity of at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 80, which have beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 80. The polypeptide preferably comprises, consists of, or consists essentially of the mature polypeptide of SEQ ID NO: 80 or the mature polypeptide thereof, or is a fragment thereof having beta-1,6-glucanase activity. In one aspect, the mature polypeptide is amino acids 17 to 487 of SEQ ID NO: 80. In another aspect, the mature polypeptide is SEQ ID NO: 81.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 83, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 83. The polypeptide preferably comprises, consists of, or consists essentially of the mature polypeptide of SEQ ID NO: 83 or the mature polypeptide thereof, or is a fragment thereof having beta-1,3-glucanase activity. In one aspect, the mature polypeptide is amino acids 20 to 458 of SEQ ID NO: 83. In another aspect, the mature polypeptide is SEQ ID NO: 84.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 86, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 86. The polypeptide preferably comprises, consists of, or consists essentially of the mature polypeptide of SEQ ID NO: 86 or the mature polypeptide thereof, or is a fragment thereof having beta-1,3-glucanase activity. In one aspect, the mature polypeptide is amino acids 20 to 286 of SEQ ID NO: 86. In another aspect, the mature polypeptide is SEQ ID NO: 87.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 89, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 89. The polypeptide preferably comprises, consists of, or consists essentially of the mature polypeptide of SEQ ID NO: 89 or the mature polypeptide thereof, or is a fragment thereof having beta-1,3-glucanase activity. In one aspect, the mature polypeptide is amino acids 20 to 284 of SEQ ID NO: 89. In another aspect, the mature polypeptide is SEQ ID NO: 90. In an embodiment, the present invention relates to isolated or purified polypeptides having a sequence identity of at least 95% identity, at least 96% identity, at least 97% identity, at least 98% identity, or at least 99% identity to the mature polypeptide of SEQ ID NO: 95, which have beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 95. The polypeptide preferably comprises, consists of, or consists essentially of the mature polypeptide of SEQ ID NO: 95 or the mature polypeptide thereof, or is a fragment thereof having beta-1,6-glucanase activity. In one aspect, the mature polypeptide is amino acids 18 to 429 of SEQ ID NO: 95. In another aspect, the mature polypeptide is SEQ ID NO: 96.

In an embodiment, the present invention relates to isolated or purified polypeptides having a sequence identity of at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 98, which have beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 98. The polypeptide preferably comprises, consists of, or consists essentially of the mature polypeptide of SEQ ID NO: 98 or the mature polypeptide thereof, or is a fragment thereof having beta-1,6-glucanase activity. In one aspect, the mature polypeptide is amino acids 18 to 429 of SEQ ID NO: 98. In another aspect, the mature polypeptide is SEQ ID NO: 99.

In an embodiment, the present invention relates to isolated or purified polypeptides having a sequence identity of at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 101, which have beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 101. The polypeptide preferably comprises, consists of, or consists essentially of the mature polypeptide of SEQ ID NO: 101 or the mature polypeptide thereof, or is a fragment thereof having beta-1,6-glucanase activity. In one aspect, the mature polypeptide is amino acids 18 to 429 of SEQ ID NO: 101. In another aspect, the mature polypeptide is SEQ ID NO: 102.

In an embodiment, the present invention relates to isolated or purified polypeptides having a sequence identity of at least 92% identity, at least 93% identity, at least 94% identity, at least 95% identity, at least 96% identity, at least 97% identity, at least 98% identity, or at least 99% identity to the mature polypeptide of SEQ ID NO: 104, which have beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 104. The polypeptide preferably comprises, consists of, or consists essentially of the mature polypeptide of SEQ ID NO: 104 or the mature polypeptide thereof, or is a fragment thereof having beta-1,6-glucanase activity. In one aspect, the mature polypeptide is amino acids 18 to 429 of SEQ ID NO: 104. In another aspect, the mature polypeptide is SEQ ID NO: 105.

In an embodiment, the present invention relates to isolated or purified polypeptides having a sequence identity of at least 95% identity, at least 96% identity, at least 97% identity, at least 98% identity, or at least 99% identity to the mature polypeptide of SEQ ID NO: 107, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 107. The polypeptide preferably comprises, consists of, or consists essentially of the mature polypeptide of SEQ ID NO: 107 or the mature polypeptide thereof, or is a fragment thereof having beta-1,3-glucanase activity. In one aspect, the mature polypeptide is amino acids 18 to 429 of SEQ ID NO: 107. In another aspect, the mature polypeptide is SEQ ID NO: 108.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 110. The polypeptide preferably comprises, consists of, or consists essentially of the mature polypeptide of SEQ ID NO: 110 or the mature polypeptide thereof, or is a fragment thereof having beta-1,3-glucanase activity. In one aspect, the mature polypeptide is amino acids 20 to 756 of SEQ ID NO: 110. In another aspect, the mature polypeptide is SEQ ID NO: 111.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 113. The polypeptide preferably comprises, consists of, or consists essentially of the mature polypeptide of SEQ ID NO: 113 or the mature polypeptide thereof, or is a fragment thereof having beta-1,3-glucanase activity. In one aspect, the mature polypeptide is amino acids 23 to 778 of SEQ ID NO: 113. In another aspect, the mature polypeptide is SEQ ID NO: 114.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 116, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 116. The polypeptide preferably comprises, consists of, or consists essentially of the mature polypeptide of SEQ ID NO: 116 or the mature polypeptide thereof, or is a fragment thereof having beta-1,3-glucanase activity. In one aspect, the mature polypeptide is amino acids 17 to 756 of SEQ ID NO: 116. In another aspect, the mature polypeptide is SEQ ID NO: 117.

In an embodiment, the present invention relates to isolated or purified polypeptides having a sequence identity of at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 119, which have beta-1,6-glucanase activity. In an embodiment, the polypeptide differs by up to 10 amino acids, e.g., 1, 2, 3, 4, 5, 6, 7, 8, 9, or 10, from the mature polypeptide of SEQ ID NO: 119. The polypeptide preferably comprises, consists of, or consists essentially of the mature polypeptide of SEQ ID NO: 119 or the mature polypeptide thereof, or is a fragment thereof having beta-1,3-glucanase activity. In one aspect, the mature polypeptide is amino acids 19 to 491 of SEQ ID NO: 119. In another aspect, the mature polypeptide is SEQ ID NO: 120.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identical, to the mature polypeptide of SEQ ID NO: 144, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 144. The polypeptide preferably comprises, consists of, or consists essentially of the polypeptide of SEQ ID NO: 144 or the mature polypeptide thereof, or is a fragment thereof having beta-1,3-glucanase activity. In one aspect, the mature polypeptide is amino acids 20 to 342 of SEQ ID NO: 144. In another aspect, the mature polypeptide is SEQ ID NO: 145.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identical to, to the mature polypeptide of SEQ ID NO: 147, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 147. The polypeptide preferably comprises, consists of, or consists essentially of the polypeptide of SEQ ID NO: 147 or the mature polypeptide thereof, or is a fragment thereof having beta-1,3-glucanase activity. In one aspect, the mature polypeptide is amino acids 20 to 292 of SEQ ID NO: 147. In another aspect, the mature polypeptide is SEQ ID NO: 148.

In an embodiment, the present invention relates to isolated or purified polypeptides having a sequence identity of at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 150, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 150. The polypeptide preferably comprises, consists of, or consists essentially of the mature polypeptide of SEQ ID NO: 150 or the mature polypeptide thereof, or is a fragment thereof having beta-1,3-glucanase activity. In one aspect, the mature polypeptide is amino acids 19 to 816 of SEQ ID NO: 150. In another aspect, the mature polypeptide is SEQ ID NO: 151.

In an embodiment, the present invention relates to isolated or purified polypeptides having a sequence identity of at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 153, which have beta-1,3-glucanase activity. In an embodiment, the polypeptide differs by up to 10 amino acids, e.g., 1, 2, 3, 4, 5, 6, 7, 8, 9, or 10, from the mature polypeptide of SEQ ID NO: 153. The polypeptide preferably comprises, consists of, or consists essentially of the mature polypeptide of SEQ ID NO: 153 or the mature polypeptide thereof, or is a fragment thereof having beta-1,3-glucanase activity. In one aspect, the mature polypeptide is amino acids 17 to 435 of SEQ ID NO: 153. In another aspect, the mature polypeptide is SEQ ID NO: 154.

In some embodiments, the present invention relates to isolated or purified polypeptides having beta-glucanase activity (e.g., beta-1,6-glucanase activity and/or beta-1,3-glucanase activity) activity encoded by polynucleotides that hybridize under medium stringency conditions, medium-high stringency conditions, high stringency conditions, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152, or the cDNA of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152 (Sambrook et al., 1989, *Molecular Cloning, A Laboratory Manual*, 2d edition, Cold Spring Harbor, New York).

The polynucleotide of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152, or a subsequence of any thereof, as well as the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153, or a fragment of any thereof, may be used to design nucleic acid probes to identify and clone DNA encoding polypeptides having beta-glucanase activity (e.g., beta-1,6-glucanase activity and/or exo- and/or endo-beta-1,3-glucanase activity) from strains of different genera or species according to methods well known in the art. Such probes can be used for hybridization with the genomic DNA or cDNA of a cell of interest, following standard Southern blotting procedures, in order to identify and isolate the corresponding gene therein. Such probes can be considerably shorter than the entire sequence, but should be at least 15, e.g., at least 25, at least 35, or at least 70 nucleotides in length. Preferably, the nucleic acid probe is at least 100 nucleotides in length, e.g., at least 200 nucleotides, at least 300 nucleotides, at least 400 nucleotides, at least 500 nucleotides, at least 600 nucleotides, at least 700 nucleotides, at least 800 nucleotides, or at least 900 nucleotides in length. Both DNA and RNA probes can be used. The probes are typically labeled for detecting the corresponding gene (for example, with $^{32}P$, $^{3}H$, $^{35}S$, biotin, or avidin). Such probes are encompassed by the present invention.

A genomic DNA or cDNA library prepared from such other strains may be screened for DNA that hybridizes with the probes described above and encodes a polypeptide having beta-glucanase activity (e.g., beta-1,6-glucanase activity and/or exo- and/or endo-beta-1,3-glucanase activity). Genomic or other DNA from such other strains may be separated by agarose or polyacrylamide gel electrophoresis, or other separation techniques. DNA from the libraries or the separated DNA may be transferred to and immobilized on nitrocellulose or another suitable carrier material. In order to identify a clone or DNA that hybridizes with SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152, or a subsequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152, the carrier material is used in a Southern blot.

For purposes of the present invention, hybridization indicates that the polynucleotides hybridize to a labeled nucleic acid probe corresponding to (i) SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152; (ii) the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152; (iii) the cDNA sequences of SEQ ID NO: 19, SEQ ID NO: 25, SEQ ID NO: 31, SEQ ID NO: 37, SEQ ID NO: 40, SEQ ID NO: 43, SEQ ID NO: 46, SEQ ID NO: 49, SEQ ID NO: 52, SEQ ID NO: 55 SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 115, or SEQ ID NO: 118; SEQ ID NO: 143, SEQ ID NO: 146, or SEQ ID NO: 149; (iv) the full-length complement of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152; or (v) a subsequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152; under medium to very high stringency conditions. Molecules to which the nucleic acid probe hybridizes under these conditions can be detected using, for example, X-ray film or any other detection means known in the art.

In another aspect, the nucleic acid probe is a polynucleotide that encodes the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153; or a fragment of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153. In another aspect, the nucleic acid probe is SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152, or the cDNA sequences of SEQ ID NO: 19, SEQ ID NO: 25, SEQ ID NO: 31, SEQ ID NO: 37, SEQ ID NO: 40, SEQ ID NO: 43, SEQ ID NO: 46, SEQ ID NO: 49, SEQ ID NO: 52, SEQ ID NO: 55 SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 115, SEQ ID NO: 118, SEQ ID NO: 143, SEQ ID NO: 146, SEQ ID NO: 149, or SEQ ID NO: 152.

In some embodiments, the present invention relates to isolated polypeptides having beta-glucanase activity (e.g., beta-1,6-glucanase activity and/or exo- and/or endo-beta-1,3-glucanase activity) encoded by polynucleotides having a sequence identity of at least 60%, e.g., at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% to: (i) the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, or SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or (ii) the cDNA sequences of SEQ ID NO: 19, SEQ ID NO: 25, SEQ ID NO: 31, SEQ ID NO: 37, SEQ ID NO: 40, SEQ ID NO: 43, SEQ ID NO: 46, SEQ ID NO: 49, SEQ ID NO: 52, SEQ ID NO: 55 SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 115, SEQ ID NO: 118, SEQ ID NO: 143, SEQ ID NO: 146, SEQ ID NO: 149, or SEQ ID NO:152.

The polynucleotide encoding the polypeptide preferably comprises, consists essentially of, or consists of: nucleotides 52 to 1290 of SEQ ID NO: 1; nucleotides 52 to 2289 of SEQ ID NO: 4; nucleotides 1 to 1143 of SEQ ID NO: 7; nucleotides 49 to 1344 of SEQ ID NO: 10; nucleotides 49 to 1338 of SEQ ID NO: 13; nucleotides 46 to 1329 of SEQ ID NO: 16; nucleotides 58 to 771 and 830 to 910 of SEQ ID NO: 19; nucleotides 58 to 864 of SEQ ID NO: 22; nucleotides 58 to 777 and 839 to 919 of SEQ ID NO: 25; nucleotides 58 to 1071 of SEQ ID NO: 28, nucleotides 55 to 868 and 931 to 1535 of SEQ ID NO: 31; nucleotides 52 to 1290 SEQ ID NO: 34; nucleotides 49 to 73, 32 to 586, 64 to 914 and 998 to 1429 of SEQ ID NO: 37; nucleotides 52 to 175 and 234 to 1348 of SEQ ID NO: 40; nucleotides 55 to 145, 213 to 851 and 922 to I181 of SEQ ID NO: 43; nucleotides 49 to 109, 161 to 297, 343 to 507 and 556 of SEQ ID NO: 46; nucleotides 49 to 552, 625 to 847 and 911 to 948 of SEQ ID NO: 49; nucleotides 55 to 653 and 713 to 941 of SEQ ID NO: 52; nucleotides 64 to 435, 486 to 676, 727 and 955 of SEQ ID NO: 55; nucleotides 58 to 453, 559 to 746 and 888 to 1116 of SEQ ID NO: 58; nucleotides 52 to 112, 183 to 319, 390 to 554 and 609 to 989 of SEQ ID NO: 61; nucleotides 55 to 784 and 839 to 1134 of SEQ ID NO: 64; nucleotides 58 to 137, 193 to 223, 280 to 610, 667 to 941, and 998 to 1165 of SEQ ID NO: 67; nucleotides 55 to 160, 213 to 262, 311 to 720, and 773 to 1022 of SEQ ID NO: 70; nucleotides 49 to 552, 691 to 913 and 996 to 1027 of SEQ ID NO: 73; nucleotides 52 to 175 and 228 to 1348 of SEQ ID NO: 76; nucleotides 49 to 862 and 919 to 1520 of SEQ ID NO: 79; nucleotides 58 to 1377 of SEQ ID NO: 82; nucleotides 58 to 780 and 837 to 917 of SEQ ID NO: 85; nucleotides 58 to 771 and 830 to 913 of SEQ ID NO: 88; nucleotides 52 to 175 and 237 to 1351 of SEQ ID NO: 94; nucleotides 52 to 175 and 234 to 1348 of SEQ ID NO: 97; nucleotides 52 to 175 and 234 to 1348 of SEQ ID NO: 100; nucleotides 52 to 175 and 237 to 1351 of SEQ ID NO: 103; nucleotides 52 to 294, 349 to 2164, or 2219 to 2391 of SEQ ID NO: 106; nucleotides 58 to 2101 and 2155 to 2324 of SEQ ID NO: 109; nucleotides 67 to 2337 of SEQ ID NO: 112; nucleotides 49 to 2101 and 2155 to 2324 of SEQ ID NO: 115; nucleotides 55 to 871 and 947 to 1551 of SEQ ID NO: 118; nucleotides 1 to 347 and 415 to 1096 of SEQ ID NO: 143; nucleotides 1 to 798 and 859 to 939 of SEQ ID NO: 146; nucleotides 1 to 337, 391 to 849, 905 to 2084, 2142 to 2234 and 2300 to 2681 of SEQ ID NO: 149; and nucleotides 1 to 1308 of SEQ ID NO: 152.

In some embodiments, the present invention relates to a polypeptide derived from a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153 by substitution, deletion or addition of one or several amino acids in the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153. In some embodiments, the present invention relates to variants of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153 comprising a substitution, deletion, and/or insertion at one or more (e.g., several) positions. In one aspect, the number of amino acid substitutions, deletions and/or insertions introduced into the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 24, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153 is up to 10, e.g., 1, 2, 3, 4, 5, 6, 7, 8, 9, or 10. In an embodiment, the polypeptide has an N-terminal extension and/or C-terminal extension of 1-10 amino acids, e.g., 1, 2, 3, 4, 5, 6, 7, 8, 9, or 10 amino acids. The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a polyhistidine tract, an antigenic epitope or a binding module.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity to the mature polypeptide of SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 83, SEQ ID NO: 86, SEQ ID NO: 89, SEQ ID NO: 107, SEQ ID NO: 110, SEQ ID NO: 113, SEQ ID NO: 116, SEQ ID NO: 144, SEQ ID NO: 147, SEQ ID NO: 150, or SEQ ID NO: 153, and wherein the polypeptide has at least 75%, at least 80%, at least 85%, at least 90%, at least 95%, at least 96%, at least 97%, at least 98%, or at least 99% of the beta-1,3-glucanase activity of the mature polypeptide of SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 83, SEQ ID NO: 86, SEQ ID NO: 89, SEQ ID NO: 107, SEQ ID NO: 110, SEQ ID NO: 113, SEQ ID NO: 116, SEQ ID NO: 144, SEQ ID NO: 147, SEQ ID NO: 150, or SEQ ID NO: 153.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of any one or more of SEQ ID NO: 2, SEQ ID NO: 32, SEQ ID NO: 35, SEQ ID NO: 38, SEQ ID NO: 41, SEQ ID NO: 77, SEQ ID NO: 80, SEQ ID NO: 92, SEQ ID NO: 95, SEQ ID NO: 98, SEQ ID NO: 101, SEQ ID NO: 104, or SEQ ID NO: 119, and wherein the polypeptide has at least 75%, at least 80%, at least 85%, at least 90%, at least 95%, at least 96%, at least 97%, at least 98%, or at least 99% of the beta-1,6-glucanase activity of the mature polypeptide of SEQ ID NO: 2, SEQ ID NO: 32, SEQ ID NO: 35, SEQ ID NO: 38, SEQ ID NO: 41, SEQ ID NO: 77, SEQ ID NO: 80, SEQ ID NO: 92, SEQ ID NO: 95, SEQ ID NO: 98, SEQ ID NO: 101, SEQ ID NO: 104, or SEQ ID NO: 119.

In another embodiment, the present invention relates to a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity, but less than 100% identity, to the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71 or SEQ ID NO: 74, and wherein the polypeptide has at least 75%, at least 80%, at least 85%, at least 90%, at least 95%, at least 96%, at least 97%, at least 98%, or at least 99% of the beta-1,6-glucanase activity and/or beta-1,3-glucanase activity of the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71 or SEQ ID NO: 74.

Essential amino acids in a polypeptide can be identified by procedures known in the art, such as site-directed mutagenesis or alanine-scanning mutagenesis (Cunningham and Wells, 1989, Science 244: 1081-1085). In the latter technique, single alanine mutations are introduced at every residue in the molecule, and the resultant molecules are tested for beta-glucanase activity (e.g., beta-1,6-glucanase activity and/or exo- and/or endo-beta-1,3-glucanase activity) to identify amino acid residues that are critical to the activity of the molecule. See also, Hilton et al., 1996, J. Biol. Chem. 271: 4699-4708. The active site of the enzyme or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., 1992, Science 255: 306-312; Smith et al., 1992, J. Mol. Biol. 224: 899-904; Wlodaver et al., 1992, FEBS Lett. 309: 59-64. The identity of essential amino acids can also be inferred from an alignment with a related polypeptide.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, Science 241: 53-57; Bowie and Sauer, 1989, Proc. Natl. Acad. Sci. USA 86: 2152-2156; WO 95/17413; or WO 95/22625. Other methods that can be used include error-prone PCR, phage display (e.g., Lowman et al., 1991, Biochemistry 30: 10832-10837; U.S. Pat. No. 5,223,409; WO 92/06204), and region-directed mutagenesis (Derbyshire et al., 1986, Gene 46: 145; Ner et al., 1988, DNA 7: 127).

Mutagenesis/shuffling methods can be combined with high-throughput, automated screening methods to detect activity of cloned, mutagenized polypeptides expressed by host cells (Ness et al., 1999, Nature Biotechnology 17: 893-896). Mutagenized DNA molecules that encode active polypeptides can be recovered from the host cells and rapidly sequenced using standard methods in the art. These methods allow the rapid determination of the importance of individual amino acid residues in a polypeptide.

In some embodiments, the polypeptide is a fragment containing at least 350 amino acid residues (e.g., amino acids 1 to 350 of SEQ ID NO: 2 or SEQ ID NO: 3), at least 370 amino acid residues (e.g., amino acids 1 to 370 of SEQ ID NO: 2 or SEQ ID NO: 3), or at least 390 amino acid residues (e.g., amino acids 1 to 390 of SEQ ID NO: 2 or SEQ ID NO: 3). In some embodiments, the polypeptide is a fragment containing at least 633 amino acid residues (e.g., amino acids 1 to 633 of SEQ ID NO: 5 or SEQ ID NO: 6), at least 671 amino acid residues (e.g., amino acids 1 to 671 of SEQ ID NO: 5 or SEQ ID NO: 6), or at least 707 amino acid residues (e.g., amino acids 1 to 707 of SEQ ID NO: 5 or SEQ ID NO: 6). In some embodiments, the polypeptide is a fragment containing at least 323 amino acid residues (e.g., amino acids 1 to 323 of SEQ ID NO: 8 or SEQ ID NO: 9), at least 342 amino acid residues (e.g., amino acids 1 to 342 of SEQ ID NO: 8 or SEQ ID NO: 9), or at least 361 amino acid residues (e.g., amino acids 1 to 361 of SEQ ID NO: 8 or SEQ ID NO: 9). In some embodiments, the polypeptide is a fragment containing 366 amino acid residues (e.g., amino acids 1 to 366 of SEQ ID NO: 11 or SEQ ID NO: 12), at least 388 amino acid residues (e.g., amino acids 1 to 388 of SEQ ID NO: 11 or SEQ ID NO: 12), or at least 409 amino acid residues (e.g., amino acids 1 to 409 of SEQ ID NO: 11 or SEQ ID NO: 12). In some embodiments, the polypeptide is a fragment containing at least 365 amino acid residues (e.g., amino acids 1 to 365 of SEQ ID NO: 14 or SEQ ID NO: 15), at least 386 amino acid residues (e.g., amino acids 1 to 386 of SEQ ID NO: 14 or SEQ ID NO: 15), or at least 408 amino acid residues (e.g., amino acids 1 to 408 of SEQ ID NO: 14 or SEQ ID NO: 15). In some embodiments, the polypeptide is a fragment containing at least 363 amino acid residues (e.g., amino acids 1 to 363 of SEQ ID NO: 17 or SEQ ID NO: 18), at least 384 amino acid residues (e.g., amino acids 1 to 384 of SEQ ID NO: 17 or SEQ ID NO: 18), or at least 406 amino acid residues (e.g., amino acids 1 to 406 of SEQ ID NO: 17 or SEQ ID NO: 18). In some embodiments, the polypeptide is a fragment containing at least 224 amino acid residues (e.g., amino acids 1 to 224 of SEQ ID NO: 20 or SEQ ID NO: 21), at least 238 amino acid residues (e.g., amino acids 1 to 238 of SEQ ID NO: 20 or SEQ ID NO: 21), or at least 251 amino acid residues (e.g., amino acids 1 to 251 of SEQ ID NO: 20 or SEQ ID NO: 21). In some embodiments, the polypeptide is a fragment containing at least 228 amino acid residues (e.g., amino acids 1 to 228 of SEQ ID NO: 23 or SEQ ID NO: 24), at least 241 amino acid residues (e.g., amino acids 1 to 241 of SEQ ID NO: 23 or SEQ ID NO: 24), or at least 255 amino acid residues (e.g., amino acids 1 to 255 of SEQ ID NO: 23 or SEQ ID NO: 24). In some embodiments, the polypeptide is a fragment containing at least 226 amino acid residues (e.g., amino acids 1 to 226 of SEQ ID NO: 26 or SEQ ID NO: 27), at least 240 amino acid residues (e.g., amino acids 1 to 240 of SEQ ID NO: 26 or SEQ ID NO: 27), or at least 253 amino acid residues (e.g., amino acids 1 to 253 of SEQ ID NO: 26 or SEQ ID NO: 27). In some embodiments, the polypeptide is a fragment containing at least 286 amino acid residues (e.g., amino acids 1 to 286 of SEQ ID NO: 29 or SEQ ID NO: 30), at least 303 amino acid residues (e.g., amino acids 1 to 303 of SEQ ID NO: 29 or SEQ ID NO: 30), or at least 320 amino acid residues (e.g., amino acids 1 to 320 of SEQ ID NO: 29 or SEQ ID NO: 30). In some embodiments, the polypeptide is a fragment containing at least 417 amino acid residues (e.g., amino acids 1 to 417 of SEQ ID NO: 32 or SEQ ID NO: 33), at least 441 amino acid residues (e.g., amino acids 1 to 441 of SEQ ID NO: 32 or SEQ ID NO: 33), or at least 466 amino acid residues (e.g., amino acids 1 to 466 of SEQ ID NO: 32 or SEQ ID NO: 33). In some embodiments, the polypeptide is a fragment containing at least 350 amino acid residues (e.g., amino acids 1 to 350 of SEQ ID NO: 35 or SEQ ID NO: 36), at least 370 amino acid residues (e.g., amino acids 1 to 370 of SEQ ID NO: 35 or SEQ ID NO: 36), or at least 390 amino acid residues (e.g., amino acids 1 to 390 of SEQ ID NO: 35 or SEQ ID NO: 36). In some embodiments, the polypeptide is a fragment containing at least 333 amino acid residues (e.g., amino acids 1 to 333 of SEQ ID NO: 38 or SEQ ID NO: 39), at least 353 amino acid residues (e.g., amino acids 1 to 353 of SEQ ID NO: 38 or SEQ ID NO: 39), or at least 372 amino acid residues (e.g., amino acids 1 to 372 of SEQ ID NO: 38 or SEQ ID NO: 39). In some embodiments, the polypeptide is a fragment containing at least 350 amino acid residues (e.g., amino acids 1 to 350 of SEQ ID NO: 41 or SEQ ID NO: 42), at least 370 amino acid residues (e.g., amino acids 1 to 370 of SEQ ID NO: 41 or SEQ ID NO: 42), or at least 390 amino acid residues (e.g., amino acids 1 to 390 of SEQ ID NO: 41 or SEQ ID NO: 42). In some embodiments, the polypeptide is a fragment containing at least 280 amino acid residues (e.g., amino acids 1 to 280 of SEQ ID NO: 44 or SEQ ID NO: 45), at least 291 amino acid residues (e.g., amino acids 1 to 291 of SEQ ID NO: 44 or SEQ ID NO: 45), or at least 313 amino acid residues (e.g., amino acids 1 to 313 of SEQ ID NO: 44 or SEQ ID NO: 45). In some embodiments, the polypeptide is a fragment containing at least 204 amino acid residues (e.g., amino acids 1 to 204 of SEQ ID NO: 47 or SEQ ID NO: 48), at least 216 amino acid residues (e.g., amino acids 1 to 216 of SEQ ID NO: 47 or SEQ ID NO: 48), or at least 228 amino acid residues (e.g., amino acids 1 to 228 of SEQ ID NO: 47 or SEQ ID NO: 48). In some embodiments, the polypeptide is a fragment containing at least 216 amino acid residues (e.g., amino acids 1 to 216 of SEQ ID NO: 50 or SEQ ID NO: 51), at least 229 amino acid residues (e.g., amino acids 1 to 229 of SEQ ID NO: 50 or SEQ ID NO: 51), or at least 242 amino acid residues (e.g., amino acids 1 to 242 of SEQ ID NO: 50 or SEQ ID NO: 51). In some embodiments, the polypeptide is a fragment containing at least 234 amino acid residues (e.g., amino acids 1 to 234 of SEQ ID NO: 53 or SEQ ID NO: 54), at least 248 amino acid residues (e.g., amino acids 1 to 248 of SEQ ID NO: 53 or SEQ ID NO: 54), or at least 261 amino acid residues (e.g., amino acids 1 to 261 of SEQ ID NO: 53 or SEQ ID NO: 54). In some embodiments, the polypeptide is a fragment containing at least 224 amino acid residues (e.g., amino acids 1 to 224 of SEQ ID NO: 56 or SEQ ID NO: 57), at least 237 amino acid residues (e.g., amino acids 1 to 237 of SEQ ID NO: 56 or SEQ ID NO: 57), or at least 250 amino acid residues (e.g., amino acids 1 to 250 of SEQ ID NO: 56 or SEQ ID NO: 57). In some embodiments, the polypeptide is a fragment containing at least 230 amino acid residues (e.g., amino acids 1 to 230 of SEQ ID NO: 59 or SEQ ID NO: 60), at least 243 amino acid residues (e.g., amino acids 1 to 243 of SEQ ID NO: 59 or SEQ ID NO: 60), or at least 257 amino acid residues (e.g., amino acids 1 to 257 of SEQ ID NO: 59 or SEQ ID NO: 60). In some embodiments, the polypeptide is a fragment containing at least 210 amino acid residues (e.g., amino acids 1 to 210 of SEQ ID NO: 62 or SEQ ID NO: 63), at least 222 amino acid residues (e.g., amino acids 1 to 222 of SEQ ID NO: 62 or SEQ ID NO: 63), or at least 235 amino acid residues (e.g., amino acids 1 to 235 of SEQ ID NO: 62 or SEQ ID NO: 63). In some embodiments, the polypeptide is a fragment containing at least 290 amino acid residues (e.g., amino acids 1 to 290 of SEQ ID NO: 65 or SEQ ID NO: 66), at least 307 amino acid residues (e.g., amino acids 1 to 307 of SEQ ID NO: 65 or SEQ ID NO: 66), or at least 324 amino acid residues (e.g., amino acids 1 to 324 of SEQ ID NO: 65 or SEQ ID NO: 66). In some embodiments, the polypeptide is a fragment containing at least 250 amino acid residues (e.g., amino acids 1 to 250 of SEQ ID NO: 68 or SEQ ID NO: 69), at least 265 amino acid residues (e.g., amino acids 1 to 265 of SEQ ID NO: 68 or SEQ ID NO: 69), or at least 279 amino acid residues (e.g., amino acids 1 to 279 of SEQ ID NO: 68 or SEQ ID NO: 69). In some embodiments, the polypeptide is a fragment containing at least 230 amino acid residues (e.g., amino acids 1 to 230 of SEQ ID NO: 71 or SEQ ID NO: 72), at least 244 amino acid residues (e.g., amino acids 1 to 244 of SEQ ID NO: 71 or SEQ ID NO: 72), or at least 257 amino acid residues (e.g., amino acids 1 to 257 of SEQ ID NO: 71 or SEQ ID NO: 72). In some embodiments, the polypeptide is a fragment containing at least 214 amino acid residues (e.g., amino acids 1 to 214 of SEQ ID NO: 74 or SEQ ID NO: 75), at least 227 amino acid residues (e.g., amino acids 1 to 227 of SEQ ID NO:74 or SEQ ID NO: 75), or at least 239 amino acid residues (e.g., amino acids 1 to 239 of SEQ ID NO: 74 or SEQ ID NO: 75). In some embodiments, the polypeptide is a fragment containing at least 366 amino acid residues (e.g., amino acids 1 to 366 of SEQ ID NO: 77 or SEQ ID NO: 78), at least 388 amino acid residues (e.g., amino acids 1 to 388 of SEQ ID NO: 77 or SEQ ID NO: 78), or at least 409 amino acids residues (e.g., amino acids 1 to 409 of SEQ ID NO: 77 or SEQ ID NO: 78). In some embodiments, the polypeptide is a fragment containing at least 414 amino acid residues (e.g., amino acids 1 to 414 of SEQ ID NO: 80 or SEQ ID NO: 81), at least 438 amino acid residues (e.g., amino acids 1 to 438 of SEQ ID NO: 80 or SEQ ID NO: 81), or at least 462 amino acid residues (e.g., amino acids 1 to 462 of SEQ ID NO: 80 or SEQ ID NO: 81). In some embodiments, the polypeptide is a fragment containing at least 389 amino acid residues (e.g., amino acids 1 to 389 of SEQ ID NO: 83 or SEQ ID NO: 84), at least 412 amino acid residues (e.g., amino acids 1 to 412 of SEQ ID NO: 83 or SEQ ID NO: 84), or at least 435 amino acid residues (e.g., amino acids 1 to 435 of SEQ ID NO: 83 or SEQ ID NO: 84). In some embodiments, the polypeptide is a fragment containing at least 243 amino acid residues (e.g., amino acids 1 to 243 of SEQ ID NO: 86 or SEQ ID NO: 87), at least 257 amino acid residues (e.g., amino acids 1 to 257 of SEQ ID NO: 86 or SEQ ID NO: 87), or at least 271 amino acid residues (e.g., amino acids 1 to 271 of SEQ ID NO: 86 or SEQ ID NO: 87). In some embodiments, the polypeptide is a fragment containing at least 244 amino acid residues (e.g., amino acids 1 to 244 of SEQ ID NO: 89 or SEQ ID NO: 90), at least 258 amino acid residues (e.g., amino acids 1 to 258 of SEQ ID NO: 89 or SEQ ID NO: 90), or at least 272 amino acid residues (e.g., amino acids 1 to 272 of SEQ ID NO: 89 or SEQ ID NO: 90). In some embodiments, the polypeptide is a fragment containing at least 351 amino acid residues (e.g., amino acids 1 to 351 of SEQ ID NO: 92 or SEQ ID NO: 93), at least 371 amino acid residues (e.g., amino acids 1 to 371 of SEQ ID NO: 92 or SEQ ID NO: 93), or at least 392 amino acid residues (e.g., amino acids 1 to 392 of SEQ ID NO: 92 or SEQ ID NO: 93). In some embodiments, the polypeptide is a fragment containing at least 364 amino acid residues (e.g., amino acids 1 to 364 of SEQ ID NOs: 95, 96, 98, 99, 101, 102, 104 or 105), at least 386 amino acid residues (e.g., amino acids 1 to 386 of SEQ ID NOs: 95, 96, 98, 99, 99, 100, or 103), or at least 407 amino acid residues (e.g., amino acids 1 to 407 of SEQ ID NOs: 95, 96, 98, 99, 101, 102, 104 or 105). In some embodiments, the polypeptide is a fragment containing at least 631 amino acid residues (e.g., amino acids 1 to 631 of SEQ ID NO: 107 or SEQ ID NO: 108), at least 668 amino acid residues (e.g., amino acids 1 to 668 of SEQ ID NO: 107 or SEQ ID NO: 108), or at least 705 amino acid residues (e.g., amino acids 1 to 705 of SEQ ID NO: 107 or SEQ ID NO: 108). In some embodiments, the polypeptide is a fragment containing at least 642 amino acid residues (e.g., amino acids 1 to 642 of SEQ ID NO: 110 or SEQ ID NO: 111), at least 680 amino acid residues (e.g., amino acids 1 to 680 of SEQ ID NO: 110 or SEQ ID NO: 111), or at least 718 amino acid residues (e.g., amino acids 1 to 718 of SEQ ID NO: 110 or SEQ ID NO: 111). In some embodiments, the polypeptide is a fragment containing at least 661 amino acid residues (e.g., amino acids 1 to 661 of SEQ ID NO: 113 or SEQ ID NO: 114), at least 700 amino acid residues (e.g., amino acids 1 to 700 of SEQ ID NO: 113 or SEQ ID NO: 114), or at least 739 amino acid residues (e.g., amino acids 1 to 739 of SEQ ID NO: 113 or SEQ ID NO: 114). In some embodiments, the polypeptide is a fragment containing at least 642 amino acid residues (e.g., amino acids 1 to 642 of SEQ ID NO: 116 or SEQ ID NO: 117), at least 680 amino acid residues (e.g., amino acids 1 to 680 of SEQ ID NO: 116 or SEQ ID NO: 117), at least 718 amino acid residues (e.g., amino acids 1 to 718 of SEQ ID NO: 116 or SEQ ID NO: 117). In some embodiments, the polypeptide is a fragment containing at least 417 amino acid residues (e.g., amino acids 1 to 417 of SEQ ID NO: 119 or SEQ ID NO: 120), at least 441 amino acid residues (e.g., amino acids 1 to 441 of SEQ ID NO: 119 or SEQ ID NO: 120), or at least 466 amino acid residues (e.g., amino acids 1 to 466 of SEQ ID NO: 119 or SEQ ID NO: 120).

The polypeptide may be a hybrid polypeptide or a fusion polypeptide.

The polypeptides of the present invention have improved properties (e.g., with significant improvement of performance and/or stability under acidic conditions). For example, the polypeptides of the present invention have beta-1,6-glucanase activity and/or exo and/or endo-beta-1,3-glucanase activity and result in improved ethanol yield when present and/or added during the saccharification, fermentation, or simultaneous saccharification and fermentation (SSF) steps of processes for producing fermentation products from starch-containing material, such as conventional starch fuel ethanol production containing a high-temperature liquefaction step and raw starch hydrolysis processes lacking said high-temperature liquefaction step. The work described in the examples herein demonstrates that the polypeptides can be used alone, or in combination with each other or other enzymes, such as a composition described herein, e.g., a cellulase/cellulolytic composition to significantly improve ethanol yields in processes for producing ethanol from corn. Unexpectedly, the work described herein demonstrates that combinations of beta-1,6-glucanases and exo- and/or endo-beta-1,3-glucanases from certain glycoside hydrolase (GH) families further significantly improves ethanol yields.

Sources of Polypeptides Having Beta-Glucanase Activity

A polypeptide having beta-glucanase activity (e.g., beta-1,6-glucanase activity and/or exo- and/or endo-beta-1,3-glucanase activity) of the present invention may be obtained from microorganisms of any genus. For purposes of the present invention, the term "obtained from" as used herein in connection with a given source shall mean that the polypeptide encoded by a polynucleotide is produced by the source or by a strain in which the polynucleotide from the source has been inserted. In one aspect, the polypeptide obtained from a given source is secreted extracellularly. In an embodiment, the polypeptide having beta-1,6-glucanase activity is of fungal origin. In an embodiment, the polypeptide having beta-1,3-glucanase activity is of fungal origin.

In another aspect, the polypeptide having beta-1,6-glucanase activity of the present invention may be obtained from microorganisms of the genus *Trichoderma*, e.g., a polypeptide obtained from *Trichoderma harzianum, Trichoderma atroviride, Trichoderma longipile, Trichoderma koningii, Trichoderma koningiopsis,* or *Trichoderma sinuosum*, from microorganisms of the genus *Simplicillium*, e.g., a polypeptide obtained from *Simplicillium lamellicola*, from microorganisms of the genus *Fusarium*, e.g., a polypeptide obtained from *Fusarium solani*, or from microorganisms of the genus *Gilmaniella*, e.g., a polypeptide obtained from *Gilmaniella humicola*, or from microorganisms of the genus *Rasamsonia*, e.g., a polypeptide obtained from *Rasamsonia byssochiamydoides*. In an aspect, the polypeptide having beta-1,6-glucanase activity is a *Trichoderma harzianum* polypeptide, for instance, the *Trichoderma harzianum* polypeptide having beta-1,6-glucanase activity of SEQ ID NO: 3 or SEQ ID NO: 33 or a variant of SEQ ID NO: 3 or SEQ ID NO: 33 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 3 or SEQ ID NO: 33. In an aspect, the polypeptide having beta-1,6-glucanase activity is a *Trichoderma* atroviride polypeptide, for instance, the *Trichoderma* atroviride polypeptide having beta-1,6-glucanase activity of SEQ ID NO: 39, SEQ ID NO: 42, or SEQ ID NO: 120, or a variant of SEQ ID NO: 39, SEQ ID NO: 42, or SEQ ID NO: 120 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 39, SEQ ID NO: 42, or SEQ ID NO: 120. In an aspect, the polypeptide having beta-1,6-glucanase activity is a *Trichoderma longipile* polypeptide, for instance, the *Trichoderma longipile* polypeptide having beta-1,6-glucanase activity of SEQ ID NO: 95 or SEQ ID NO: 96 or a variant of SEQ ID NO: 95 or SEQ ID NO: 96 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 95 or SEQ ID NO: 96. In an aspect, the polypeptide having beta-1,6-glucanase activity is a *Trichoderma koningiopsis* polypeptide, for instance, the *Trichoderma koningiopsis* polypeptide having beta-1,6-glucanase activity of SEQ ID NO: 98 or SEQ ID NO: 99 or a variant of SEQ ID NO: 98 or SEQ ID NO: 99 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 98 or SEQ ID NO: 99. In an aspect, the polypeptide having beta-1,6-glucanase activity is a *Trichoderma koningiopsis* polypeptide, for instance, the *Trichoderma koningii* polypeptide having beta-1,6-glucanase activity of SEQ ID NO: 101 or SEQ ID NO: 102 or a variant of SEQ ID NO: 101 or SEQ ID NO: 102 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 101 or SEQ ID NO: 102. In an aspect, the polypeptide having beta-1,6-glucanase activity is a *Trichoderma sinuosum* polypeptide, for instance, the *Trichoderma sinuosum* polypeptide having beta-1,6-glucanase activity of SEQ ID NO: 104 or SEQ ID NO: 105 or a variant of SEQ ID NO: 104 or SEQ ID NO: 105 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 104 or SEQ ID NO: 105. In an aspect, the polypeptide having beta-1,6-glucanase activity is a *Simplicillium lamellicola* polypeptide, for instance, the *Simplicillium lamellicola* polypeptide having beta-1,6-glucanase activity of SEQ ID NO: 36 or a variant thereof having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 36. In an aspect, the polypeptide having beta-1,6-glucanase activity is a *Fusarium solani* polypeptide, for instance, the *Fusarium solani* polypeptide having beta-1,6-glucanase activity of SEQ ID NO: 78 or a variant thereof having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 78. In an aspect, the polypeptide having beta-1,6-glucanase activity is a *Gilmaniella humicola* polypeptide, for instance, the *Gilmaniella humicola* polypeptide having beta-1,6-glucanase activity of SEQ ID NO: 81 or a variant thereof having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 81. In an aspect, the polypeptide having beta-1,6-glucanase activity is a *Rasamsonia byssochlamydoides* polypeptide, for instance, the *Rasamsonia byssochiamydoides* polypeptide having beta-1,6-glucanase activity of SEQ ID NO: 91 or a variant thereof having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 91.

In another aspect, the polypeptide having endo- and/or exo-beta-1,3-glucanase activity of the present invention may be obtained from microorganisms of the genus *Trichoderma*, e.g., a polypeptide obtained from *Trichoderma harzianum*, *Trichoderma reesei*, *Trichoderma atroviride*, *Trichoderma longipile*, *Trichoderma koningiopsis*, *Trichoderma koningii*, or *Trichoderma sinuosum*, from a microorganism of the genus Lecanicillium, e.g., *Lecanicillium primulinum* or Lecanicillium sp. WMM742, or from a microorganism of the genus *Simplicillium*, e.g., *Simplicillium lamellicola*, from a microorganism of the genus *Aspergillus*, e.g., *Aspergillus nidulans*, from a microorganism of the genus *Gliomastix*, e.g., *Gliomastix murorum*, from a microorganism of the genus *Albifimbria*, e.g., *Albifimbria verrucaria*, from a microorganism of the genus *Hamigera*, e.g., *Hamigera inflate*, or from a microorganism of the genus *Acremonium*, e.g., *Acremonium exiguum*.

In an aspect, the polypeptide having exo- and/or endo-beta-1,3-glucanase activity is a *Trichoderma harzianum* polypeptide, for instance, the *Trichoderma harzianum* polypeptide having exo- and/or endo-beta-1,3-glucanase activity of SEQ ID NO: 9, SEQ ID NO: 12, SEQ ID NO: 108, SEQ ID NO: 147 or a variant of SEQ ID NO: 9, SEQ ID NO: 12, SEQ ID NO: 108, or SEQ ID NO: 147 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 9, SEQ ID NO: 12, SEQ ID NO: 108, or SEQ ID NO: 147.

In an aspect, the polypeptide having exo- and/or endo-beta-1,3-glucanase activity is a *Lecanicillium primulinum* polypeptide, for instance, the *Lecanicillium primulinum* polypeptide having exo- and/or endo-beta-1,3-glucanase activity of SEQ ID NO: 15 or a variant of SEQ ID NO: 15 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 15.

In an aspect, the polypeptide having exo- and/or endo-beta-1,3-glucanase activity is a *Lecanicillium* sp. WMM742 polypeptide, for instance, the *Lecanicillium* sp. WMM742 polypeptide having exo- and/or endo-beta-1,3-glucanase activity of SEQ ID NO: 90 or a variant of SEQ ID NO: 90 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 90. In an aspect, the polypeptide having exo- and/or endo-beta-1,3-glucanase activity is a *Simplicillium lamellicola* polypeptide, for instance, the *Simplicillium lamellicola* polypeptide having exo- and/or endo-beta-1,3-glucanase activity of SEQ ID NO: 18, SEQ ID NO: 21, or SEQ ID NO: 114, or a variant of SEQ ID NO: 18, SEQ ID NO: 21, or SEQ ID NO: 114 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 18, SEQ ID NO: 21, or SEQ ID NO: 114.

In an aspect, the polypeptide having exo- and/or endo-beta-1,3-glucanase activity is a *Trichoderma reesei* polypeptide, for instance, the *Trichoderma reesei* polypeptide having exo- and/or endo-beta-1,3-glucanase activity of SEQ ID NO: 24 or a variant of SEQ ID NO: 24 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 24.

In an aspect, the polypeptide having exo- and/or endo-beta-1,3-glucanase activity is a *Trichoderma atroviride* polypeptide, for instance, the *Trichoderma atroviride* polypeptide having exo- and/or endo-beta-1,3-glucanase activity of SEQ ID NO: 27, SEQ ID NO: 111, or SEQ ID NO: 117, or a variant of SEQ ID NO: 27, SEQ ID NO: 111, or SEQ ID NO: 117 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 27, SEQ ID NO: 111, or SEQ ID NO: 117.

In an aspect, the polypeptide having exo- and/or endo-beta-1,3-glucanase activity is a *Gliomastix murorum* polypeptide, for instance, the *Gliomastix murorum* polypeptide having exo- and/or endo-beta-1,3-glucanase activity of SEQ ID NO: 84 or a variant of SEQ ID NO: 84 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 84.

In an aspect, the polypeptide having exo- and/or endo-beta-1,3-glucanase activity is a *Albifimbria verrucara* polypeptide, for instance, the *Albifimbria verrucara* polypeptide having exo- and/or endo-beta-1,3-glucanase activity of SEQ ID NO: 87 or a variant of SEQ ID NO: 87 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 87.

In an aspect, the polypeptide having exo- and/or endo-beta-1,3-glucanase activity is a *Aspergillus nidulans* FGSC A4 polypeptide, for instance, the *Aspergillus nidulans* FGSC A4 polypeptide having exo- and/or endo-beta-1,3-glucanase activity of SEQ ID NO: 144 or a variant of SEQ ID NO: 144 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 144.

In an aspect, the polypeptide having exo- and/or endo-beta-1,3-glucanase activity is a *Hamigera inflate* polypeptide, for instance, the *Hamigera inflata* polypeptide having exo- and/or endo-beta-1,3-glucanase activity of SEQ ID NO: 150 or a variant of SEQ ID NO: 150 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 150.

In an aspect, the polypeptide having exo- and/or endo-beta-1,3-glucanase activity is a *Acremonium exiguum* polypeptide, for instance, the *Acremonium exiguum* polypeptide having exo- and/or endo-beta-1,3-glucanase activity of SEQ ID NO: 153 or a variant of SEQ ID NO: 153 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 153. In another aspect, the polypeptide having beta-1,6-glucanase activity and/or endo- and/or exo-beta-1,3-glucanase activity of the present invention may be obtained from microorganisms of the genus *Comyascus*, e.g., *Comyascus sepedonium*, or from microorganisms of the genus *Aspergillus*, e.g., *Aspergillus wentii*, or from microorganisms of the genus *Acrophialophora*, e.g., *Acrophialophora fusispora*, or from a microorganism of the genus *Rhinocladiella*, e.g., *Rhinocladiella* sp., or from a microorganism of the genus *Nemania*, e.g., *Nemania serpens*, or from a microorganism of the genus *Talaromyces*, e.g., *Talaromyces leycettanus*, or from a microorganism of the genus *Collariella*, e.g., *Collariella virescens*, or from a microorganism of the genus *Rigidoporus*, e.g., *Rigidoporus* sp. 74222, or from a microorganism of the genus Loramyces, e.g., *Loramyces macrosporus*.

In an aspect, the polypeptide having beta-1,6-glucanase activity and/or endo- and/or exo-beta-1,3-glucanase activity is a *Comyascus sepedonium* polypeptide, for instance, the *Comyascus sepedonium* polypeptide having exo- and/or endo-beta-1,3-glucanase activity of SEQ ID NO: 45 or SEQ ID NO: 75 or a variant of SEQ ID NO: 45 or SEQ ID NO: 75 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 45 or SEQ ID NO: 75.

In an aspect, the polypeptide having beta-1,6-glucanase activity and/or endo- and/or exo-beta-1,3-glucanase activity is a *Aspergillus wentii* polypeptide, for instance, the *Aspergillus wentii* polypeptide having exo- and/or endo-beta-1,3-glucanase activity of SEQ ID NO: 48 or a variant of SEQ ID NO: 48 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 48.

In an aspect, the polypeptide having beta-1,6-glucanase activity and/or endo- and/or exo-beta-1,3-glucanase activity is a *Acrophialophora fusispora* polypeptide, for instance, the *Acrophialophora fusispora* polypeptide having exo- and/or endo-beta-1,3-glucanase activity of SEQ ID NO: 51 or SEQ ID NO: 54 or a variant of SEQ ID NO: 51 or SEQ ID NO: 54 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 51 or SEQ ID NO: 54.

In an aspect, the polypeptide having beta-1,6-glucanase activity and/or endo- and/or exo-beta-1,3-glucanase activity is a *Rhinocladiella* sp. polypeptide, for instance, the *Rhinocladiella* sp. polypeptide having exo- and/or endo-beta-1, 3-glucanase activity of SEQ ID NO: 57 or a variant of SEQ ID NO: 57 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 57.

In an aspect, the polypeptide having beta-1,6-glucanase activity and/or endo- and/or exo-beta-1,3-glucanase activity is a *Nemania serpens* polypeptide, for instance, the *Nemania serpens* polypeptide having exo- and/or endo-beta-1,3-glucanase activity of SEQ ID NO: 60 or a variant of SEQ ID NO: 60 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 60.

In an aspect, the polypeptide having beta-1,6-glucanase activity and/or endo- and/or exo-beta-1,3-glucanase activity is a *Talaromyces leycettanus* polypeptide, for instance, the *Talaromyces leycettanus* polypeptide having exo- and/or endo-beta-1,3-glucanase activity of SEQ ID NO: 63 or a variant of SEQ ID NO: 63 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 63.

In an aspect, the polypeptide having beta-1,6-glucanase activity and/or endo- and/or exo-beta-1,3-glucanase activity is a *Collariella virescens* polypeptide, for instance, the *Collariella virescens* polypeptide having exo- and/or endo-beta-1,3-glucanase activity of SEQ ID NO: 66 or a variant of SEQ ID NO: 66 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 66.

In an aspect, the polypeptide having beta-1,6-glucanase activity and/or endo- and/or exo-beta-1,3-glucanase activity is a *Rigidoporus* sp. 74222 polypeptide, for instance, the *Rigidoporus* sp. 74222 polypeptide having exo- and/or endo-beta-1,3-glucanase activity of SEQ ID NO: 69 or a variant of SEQ ID NO: 69 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 69.

In an aspect, the polypeptide having beta-1,6-glucanase activity and/or endo- and/or exo-beta-1,3-glucanase activity is a *Loramyces macrosporus* polypeptide, for instance, the *Loramyces macrosporus* polypeptide having exo- and/or endo-beta-1,3-glucanase activity of SEQ ID NO: 72 or a variant of SEQ ID NO: 72 having at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to SEQ ID NO: 72.

It will be understood that for the aforementioned species, the invention encompasses both the perfect and imperfect states, and other taxonomic equivalents, e.g., anamorphs, regardless of the species name by which they are known. Those skilled in the art will readily recognize the identity of appropriate equivalents.

Strains of these species are readily accessible to the public in a number of culture collections, such as the American Type Culture Collection (ATCC), Deutsche Sammlung von Mikroorganismen und Zellkulturen GmbH (DSMZ), Centraalbureau Voor Schimmelcultures (CBS), and Agricultural Research Service Patent Culture Collection, Northern Regional Research Center (NRRL).

The polypeptides may be identified and obtained from other sources including microorganisms isolated from nature (e.g., soil, composts, water, etc.) or DNA samples obtained directly from natural materials (e.g., soil, composts, water, etc.) using the above-mentioned probes. Techniques for isolating microorganisms and DNA directly from natural habitats are well known in the art. A polynucleotide encoding the polypeptide may then be obtained by similarly screening a genomic DNA or cDNA library of another microorganism or mixed DNA sample. Once a polynucleotide encoding a polypeptide has been detected with the probe(s), the polynucleotide can be isolated or cloned by utilizing techniques that are known to those of ordinary skill in the art (see, e.g., Sambrook et al., 1989, supra).

Binding Modules, Catalytic Domains and Fusion Polypeptides

The present invention contemplates the carbohydrate binding modules and catalytic domains below, variants of the carbohydrate binding modules and catalytic domains, and fusion polypeptides comprising the catalytic domains and carbohydrate binding modules.

In some embodiments, the present invention also relates to a carbohydrate binding module having a sequence identity of at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% to amino acids 311 to 347 of SEQ ID NO: 44 or amino acids 323 to 359 of SEQ ID NO: 65, and which have carbohydrate binding activity. In one aspect, the carbohydrate binding modules comprise amino acid sequences that differ by up to 10 amino acids, e.g., 1, 2, 3, 4, 5, 6, 7, 8, 9, or 10, from amino acids 311 to 347 of SEQ ID NO: 44 or amino acids 323 to 359 of SEQ ID NO: 65.

In some embodiments, the present invention also relates to polypeptides (e.g., fusion polypeptides) comprising a catalytic domain and a carbohydrate binding module, wherein the carbohydrate binding module has a sequence identity of at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% to amino acids 311 to 347 of SEQ ID NO: 44 or amino acids 323 to 359 of SEQ ID NO: 65. In one aspect, the carbohydrate binding modules comprise amino acid sequences that differ by up to 10 amino acids, e.g., 1, 2, 3, 4, 5, 6, 7, 8, 9, or 10, from amino acids 311 to 347 of SEQ ID NO: 44 or amino acids 323 to 359 of SEQ ID NO: 65, and which have beta-glucanase activity.

The carbohydrate binding module preferably comprises, consists essentially of, or consists of amino acids 311 to 347 of SEQ ID NO: 44 or amino acids 323 to 359 of SEQ ID NO: 65; or is a fragment thereof having carbohydrate binding activity.

In some embodiments, the present invention also relates to carbohydrate binding modules encoded by polynucleotides that hybridize under medium stringency conditions, medium-high stringency conditions, high stringency conditions, or very high stringency conditions with the full-length complement of nucleotides 1068 to 1178 of SEQ ID NO: 44 or nucleotides 1021 to 1128 of SEQ ID NO: 65 or the cDNA thereof (Sambrook et al., 1989, supra).

In some embodiments, the present invention also relates to carbohydrate binding modules encoded by polynucleotides having a sequence identity of at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% to nucleotides 1068 to 1178 of SEQ ID NO: 44 or nucleotides 1021 to 1128 of SEQ ID NO: 65, or the cDNA thereof.

The polynucleotide encoding the carbohydrate binding module preferably comprises, consists essentially of, or consists of nucleotides 1068 to 1178 of SEQ ID NO: 44 or nucleotides 1021 to 1128 of SEQ ID NO: 65, or the cDNA thereof.

In some embodiments, the present invention relates to a carbohydrate binding module derived from amino acids 311 to 347 of SEQ ID NO: 44 or amino acids 311 to 347 of SEQ ID NO: 45 by substitution, deletion or addition of one or several amino acids in the amino acids 311 to 347 of SEQ ID NO: 44 or amino acids 311 to 347 of SEQ ID NO: 45. In some embodiments, the present invention also relates to carbohydrate binding module variants of amino acids 311 to 347 of SEQ ID NO: 44 comprising a substitution, deletion, and/or insertion at one or more (e.g., several) positions. In one aspect, the number of amino acid substitutions, deletions and/or insertions introduced into the sequence of amino acids 311 to 347 of SEQ ID NO: 44 is up to 10, e.g., 1, 2, 3, 4, 5, 6, 8, 9, or 10.

The catalytic domain may be from a hydrolase, isomerase, ligase, lyase, oxidoreductase, or transferase, e.g., an aminopeptidase, amylase, carbohydrase, carboxypeptidase, catalase, cellobiohydrolase, cellulase, chitinase, cutinase, cyclodextrin glycosyltransferase, deoxyribonuclease, endoglucanase, esterase, alpha-galactosidase, beta-galactosidase, glucoamylase, alpha-glucosidase, beta-glucosidase, invertase, laccase, lipase, mannosidase, mutanase, oxidase, pectinolytic enzyme, peroxidase, phytase, polyphenoloxidase, proteolytic enzyme, ribonuclease, transglutaminase, xylanase, or beta-xylosidase. In an embodiment, the catalytic domain is from a beta-glucanase. In an embodiment, the catalytic domain is from a polypeptide having beta-1,6-glucanase activity. In an embodiment, the catalytic domain is from a polypeptide having exo- and/or -endo-beta-1,3-glucanase activity. In an embodiment, the catalytic domain is from a polypeptide having beta-1,6-glucanase and/or exo- and/or endo-beta-1,3-glucanase activity. In an embodiment, the catalytic domain comprises a GH5_15 catalytic domain. In an embodiment, the catalytic domain comprises a GH30_3 catalytic domain. In an embodiment, the catalytic domain comprises a GH55_3 catalytic domain. In an embodiment, the catalytic domain comprises a GH64 catalytic domain. In an embodiment, the catalytic domain comprises a GH16 catalytic domain. In an embodiment, the catalytic domain comprises a GH131 catalytic domain.

In addition to the above mentioned fusion polypeptides, the present invention contemplates the below catalytic domains and catalytic domain variants, as well as fusion polypeptides comprising the below catalytic domains and catalytic domain variants. In an embodiment, the catalytic domain comprises a GH5_15 catalytic domain catalyzing beta-1,6-glucanase activity. Exemplary such catalytic domains include: (i) amino acids 21 to 429 of SEQ ID NO: 2 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 2, and which has beta-1,6-glucanase activity; (ii) amino acids 17 to 428 of SEQ ID NO: 35 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 17 to 428 of SEQ ID NO: 35, and which has beta-1,6-glucanase activity; (iii) amino acids 17 to 408 of SEQ ID NO: 38 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 38, and which has beta-1,6-glucanase activity; (iv) amino acids 21 to 429 of SEQ ID NO: 41 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 41, and which has beta-1,6-glucanase activity; (v) amino acids 18 to 431 of SEQ ID NO: 77 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 18 to 431 of SEQ ID NO: 77, and which has beta-1,6-glucanase activity; (vi) amino acids 20 to 413 of SEQ ID NO: 92 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 413 of SEQ ID NO: 92, and which has beta-1,6-glucanase activity; (vii) amino acids 21 to 429 of SEQ ID NO: 95 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 95, and which has beta-1,6-glucanase activity; (viii) amino acids 21 to 429 of SEQ ID NO: 98 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 413 of SEQ ID NO: 98, and which has beta-1,6-glucanase activity; (ix) amino acids 21 to 429 of SEQ ID NO: 101 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 101, and which has beta-1,6-glucanase activity; or (x) amino acids 21 to 429 of SEQ ID NO: 104 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 104, and which has beta-1,6-glucanase activity.

In an embodiment, the catalytic domain comprises a GH30_3 catalytic domain catalyzing beta-1,6-glucanase activity. Examples of such catalytic domains include: (i) amino acids 76 to 419 of SEQ ID NO: 32 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 76 to 419 of SEQ ID NO: 32, and which has beta-1,6-glucanase activity; (ii) amino acids 74 to 416 of SEQ ID NO: 80 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 74 to 416 of SEQ ID NO: 80, and which has beta-1,6-glucanase activity; and (iii) amino acids 77 to 420 of SEQ ID NO: 119 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 77 to 420 of SEQ ID NO: 119, and which has beta-1,6-glucanase activity.

In an embodiment, the catalytic domain comprises a GH55_3 catalytic domain catalyzing exo- and/or endo-beta-1,3-glucanase activity. Examples of such catalytic domains include: (i) amino acids 34 to 743 of SEQ ID NO: 107 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 34 to 743 of SEQ ID NO: 107, and which has beta-1,3-glucanase activity; (ii) amino acids 34 to 756 of SEQ ID NO: 110, or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 34 to 756 of SEQ ID NO: 110; (iii) amino acids 40 to 776 of SEQ ID NO: 113 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 40 to 743 of SEQ ID NO: 113, and which has beta-1,3-glucanase activity; or (iv) amino acids 34 to 756 of SEQ ID NO: 116, or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 34 to 756 of SEQ ID NO: 116.

In an embodiment, the catalytic domain comprises a GH64 catalytic domain catalyzing exo- and/or endo-beta-1,3-glucanase activity. Examples of such catalytic domains include: (i) amino acids 1 to 380 of SEQ ID NO: 8 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 1 to 380 of SEQ ID NO: 8, and which has exo- and/or endo-beta-1,3-glucanase activity; (ii) amino acids 64 to 447 of SEQ ID NO: 11 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 64 to 447 of SEQ ID NO: 11, and which has exo- and/or endo-beta-1,3-glucanase activity; (iii) amino acids 69 to 443 of SEQ ID NO: 14 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 69 to 443 of SEQ ID NO: 14, and which has exo- and/or endo-beta-1,3-glucanase activity; (iv) amino acids 73 to 440 of SEQ ID NO: 17 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 73 to 440 of SEQ ID NO: 17, and which has exo- and/or endo-beta-1,3-glucanase activity; and (v) amino acids 20 to 458 of SEQ ID NO: 83 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 458 of SEQ ID NO: 83, and which has exo- and/or endo-beta-1,3-glucanase activity.

In an embodiment, the catalytic domain comprises a GH16 catalytic domain catalyzing exo- and/or endo-beta-1,3-glucanase activity. Examples of such catalytic domains include: (i) amino acids 26 to 283 of SEQ ID NO: 20 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 26 to 283 of SEQ ID NO: 20, and which has exo- and/or endo-beta-1,3-glucanase activity; (ii) amino acids 26 to 287 of SEQ ID NO: 23 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 26 to 287 of SEQ ID NO: 23, and which has exo- and/or endo-beta-1,3-glucanase activity; (iii) amino acids 26 to 285 of SEQ ID NO: 26 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 26 to 285 of SEQ ID NO: 26, and which has exo- and/or endo-beta-1,3-glucanase activity; (iv) amino acids 34 to 323 of SEQ ID NO: 29 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 34 to 323 of SEQ ID NO: 29, and which has exo- and/or endo-beta-1,3-glucanase activity; (v) amino acids 20 to 286 of SEQ ID NO: 86 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 286 of SEQ ID NO: 86, and which has exo- and/or endo-beta-1,3-glucanase activity; and (vi) amino acids 20 to 284 of SEQ ID NO: 89 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 284 of SEQ ID NO: 89, and which has exo- and/or endo-beta-1,3-glucanase activity.

In an embodiment, the catalytic domain comprises a GH131 catalytic domain catalyzing beta-1,6-glucanase activity and/or exo- and/or endo-beta-1,3-glucanase activity. Examples of such catalytic domains include: (i) amino acids 19 to 259 of SEQ ID NO: 44 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 19 to 259 of SEQ ID NO: 44, and which has beta-1,6-glucanase activity and/or exo- and/or endo-beta-1,3-glucanase activity; (ii) amino acids 17 to 251 of SEQ ID NO: 47 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 17 to 251 of SEQ ID NO: 47, and which has beta-1,6-glucanase activity and/or exo- and/or endo-beta-1,3-glucanase activity; (iii) amino acids 18 to 258 of SEQ ID NO: 50 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 18 to 258 of SEQ ID NO: 50, and which has beta-1,6-glucanase activity and/or exo- and/or endo-beta-1,3-glucanase activity; (iv) amino acids 38 to 393 of SEQ ID NO: 53 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 38 to 393 of SEQ ID NO: 53, and which has beta-1,6-glucanase activity and/or exo- and/or endo-beta-1,3-glucanase activity; (v) amino acids 30 to 284 of SEQ ID NO: 56 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 30 to 284 of SEQ ID NO: 56, and which has beta-1,6-glucanase activity and/or exo- and/or endo-beta-1,3-glucanase activity; (vi) amino acids 36 to 289 of SEQ ID NO: 59 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids amino acids 36 to 289 of SEQ ID NO: 59, and which has beta-1,6-glucanase activity and/or exo- and/or endo-beta-1,3-glucanase activity; (vii) amino acids 20 to 258 of SEQ ID NO: 62 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 258 of SEQ ID NO: 62, and which has beta-1,6-glucanase activity and/or exo- and/or endo-beta-1,3-glucanase activity; (viii) amino acids 22 to 306 of SEQ ID NO: 68 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 22 to 306 of SEQ ID NO: 68, and which has beta-1,6-glucanase activity and/or exo- and/or endo-beta-1,3-glucanase activity; (ix) amino acids 23 to 285 of SEQ ID NO: 71 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 23 to 285 of SEQ ID NO: 71, and which has beta-1,6-glucanase activity and/or exo- and/or endo-beta-1,3-glucanase activity; and (x) amino acids 17 to 258 of SEQ ID NO: 74 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 17 to 258 of SEQ ID NO: 74, and which has beta-1,6-glucanase activity and/or exo- and/or endo-beta-1,3-glucanase activity.

The polynucleotide encoding the catalytic domain may be obtained from any prokaryotic, eukaryotic, or other source.

The polypeptides may further comprise a linker between the catalytic domain and the carbohydrate binding module.

Polynucleotides

The present invention also relates to isolated polynucleotides encoding a polypeptide, a catalytic domain, or carbohydrate binding module of the present invention, as described herein.

The techniques used to isolate or clone a polynucleotide are known in the art and include isolation from genomic DNA or cDNA, or a combination thereof. The cloning of the polynucleotides from genomic DNA can be effected, e.g., by using the polymerase chain reaction (PCR) or antibody screening of expression libraries to detect cloned DNA fragments with shared structural features. See, e.g., Innis et al., 1990, PCR: A Guide to Methods and Application, Academic Press, New York. Other nucleic acid amplification procedures such as ligase chain reaction (LCR), ligation activated transcription (LAT) and polynucleotide-based amplification (NASBA) may be used. The polynucleotides may be cloned from a strain of Trichoderma, Lecanicillium, Simplicillium, Aspergillus, Comyascus, Acrophialophora, Rhinocladiella, Nemania, Talaromyces, Collariella, Rigidoporous, and/or Loramyces, or a related organism and thus, for example, may be a species variant of the polypeptide encoding region of the polynucleotide.

Modification of a polynucleotide encoding a polypeptide of the present invention may be necessary for synthesizing polypeptides substantially similar to the polypeptide. The term "substantially similar" to the polypeptide refers to non-naturally occurring forms of the polypeptide. These polypeptides may differ in some engineered way from the polypeptide isolated from its native source, e.g., variants that differ in specific activity, thermostability, pH optimum, or the like. The variants may be constructed on the basis of the polynucleotide presented as the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, or SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152 e.g., a subsequence thereof, and/or by introduction of nucleotide substitutions that do not result in a change in the amino acid sequence of the polypeptide, but which correspond to the codon usage of the host organism intended for production of the enzyme, or by introduction of nucleotide substitutions that may give rise to a different amino acid sequence. For a general description of nucleotide substitution, see, e.g., Ford et al., 1991, Protein Expression and Purification 2: 95-107.

Nucleic Acid Constructs

The present invention also relates to nucleic acid constructs comprising a polynucleotide of the present invention, wherein the polynucleotide is operably linked to one or more control sequences that direct the expression of the coding sequence in a suitable host cell under conditions compatible with the control sequences.

The polynucleotide may be manipulated in a variety of ways to provide for expression of the polypeptide. Manipulation of the polynucleotide prior to its insertion into a vector may be desirable or necessary depending on the expression vector. The techniques for modifying polynucleotides utilizing recombinant DNA methods are well known in the art.

The control sequence may be a promoter, a polynucleotide that is recognized by a host cell for expression of a polynucleotide encoding a polypeptide of the present invention. The promoter contains transcriptional control sequences that mediate the expression of the polypeptide. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the polynucleotide of the present invention in a bacterial host cell are the promoters obtained from the Bacillus amyloliquefaciens alpha-amylase gene (amyQ), Bacillus licheniformis alpha-amylase gene (amyL), Bacillus licheniformis penicillinase gene (penP), Bacillus stearothermophilus maltogenic amylase gene (amyM), Bacillus subtilis levansucrase gene (sacB), Bacillus subtilis xylA and xylB genes, Bacillus thuringiensis cryIIIA gene (Agaisse and Lereclus, 1994, Molecular Microbiology 13: 97-107), E. coli lac operon, E. coli trc promoter (Egon et al., 1988, Gene 69: 301-315), Streptomyces coelicolor agarase gene (dagA), and prokaryotic beta-lactamase gene (Villa-Kamaroff et al., 1978, Proc. Natl. Acad. Sci. USA 75: 3727-3731), as well as the tac promoter (DeBoer et al., 1983, Proc. Natl. Acad. Sci. USA 80: 21-25). Further promoters are described in "Useful proteins from recombinant bacteria" in Gilbert et al., 1980, Scientific American 242: 74-94; and in Sambrook et al., 1989, supra. Examples of tandem promoters are disclosed in WO 99/43835.

Examples of suitable promoters for directing transcription of the polynucleotide of the present invention in a filamentous fungal host cell are promoters obtained from the genes for Aspergillus nidulans acetamidase, Aspergillus niger neutral alpha-amylase, Aspergillus niger acid stable alpha-amylase, Aspergillus niger or Aspergillus awamori glucoamylase (glaA), Aspergillus oryzae TAKA amylase, Aspergillus oryzae alkaline protease, Aspergillus oryzae triose phosphate isomerase, Fusarium oxysporum trypsin-like protease (WO 96/00787), Fusarium venenatum amyloglucosidase (WO 00/56900), Fusarium venenatum Daria (WO 00/56900), Fusarium venenatum Quinn (WO 00/56900), Rhizomucor miehei lipase, Rhizomucor miehei aspartic proteinase, Trichoderma reesei beta-glucosidase, Trichoderma reesei cellobiohydrolase I, Trichoderma reesei cellobiohydrolase II, Trichoderma reesei endoglucanase I, Trichoderma reesei endoglucanase II, Trichoderma reesei endoglucanase III, Trichoderma reesei endoglucanase V, Trichoderma reesei xylanase I, Trichoderma reesei xylanase II, Trichoderma reesei xylanase III, Trichoderma reesei beta-xylosidase, and Trichoderma reesei translation elongation factor, as well as the NA2-tpi promoter (a modified promoter from an Aspergillus neutral alpha-amylase gene in which the untranslated leader has been replaced by an untranslated leader from an Aspergillus triose phosphate isomerase gene; non-limiting examples include modified promoters from an Aspergillus niger neutral alpha-amylase gene in which the untranslated leader has been replaced by an untranslated leader from an Aspergillus nidulans or Aspergillus oryzae triose phosphate isomerase gene); and mutant, truncated, and hybrid promoters thereof. Other promoters are described in U.S. Pat. No. 6,011,147.

In a yeast host, useful promoters are obtained from the genes for Saccharomyces cerevisiae enolase (ENO-1), Saccharomyces cerevisiae galactokinase (GAL1), Saccharomyces cerevisiae alcohol dehydrogenase/glyceraldehyde-3-phosphate dehydrogenase (ADH1, ADH2/GAP), Saccharomyces cerevisiae triose phosphate isomerase (TPI), Saccharomyces cerevisiae metallothionein (CUP1), and Saccharomyces cerevisiae 3-phosphoglycerate kinase. Other useful promoters for yeast host cells are described by Romanos et al., 1992, Yeast 8: 423-488.

The control sequence may also be a transcription terminator, which is recognized by a host cell to terminate transcription. The terminator is operably linked to the 3'-terminus of the polynucleotide encoding the polypeptide. Any terminator that is functional in the host cell may be used in the present invention.

Preferred terminators for bacterial host cells are obtained from the genes for Bacillus clausii alkaline protease (aprH), Bacillus licheniformis alpha-amylase (amyL), and Escherichia coli ribosomal RNA (rrnB).

Preferred terminators for filamentous fungal host cells are obtained from the genes for Aspergillus nidulans acetamidase, Aspergillus nidulans anthranilate synthase, Aspergillus niger glucoamylase, Aspergillus niger alpha-glucosidase, Aspergillus oryzae TAKA amylase, Fusarium oxysporum trypsin-like protease, Trichoderma reesei beta-glucosidase, Trichoderma reesei cellobiohydrolase I, Trichoderma reesei cellobiohydrolase II, Trichoderma reesei endoglucanase I, Trichoderma reesei endoglucanase II, Trichoderma reesei endoglucanase Ill, Trichoderma reesei endoglucanase V, Trichoderma reesei xylanase I, Trichoderma reesei xylanase II, Trichoderma reesei xylanase Ill, Trichoderma reesei beta-xylosidase, and Trichoderma reesei translation elongation factor.

Preferred terminators for yeast host cells are obtained from the genes for Saccharomyces cerevisiae enolase, Saccharomyces cerevisiae cytochrome C (CYC1), and Saccharomyces cerevisiae glyceraldehyde-3-phosphate dehydrogenase. Other useful terminators for yeast host cells are described by Romanos et al., 1992, supra.

The control sequence may also be an mRNA stabilizer region downstream of a promoter and upstream of the coding sequence of a gene which increases expression of the gene.

Examples of suitable mRNA stabilizer regions are obtained from a Bacillus thuringiensis cryIIIA gene (WV 94/25612) and a Bacillus subtilis SP82 gene (Hue et al., 1995, J. Bacterol. 177: 3465-3471).

The control sequence may also be a leader, a nontranslated region of an mRNA that is important for translation by the host cell. The leader is operably linked to the 5'-terminus of the polynucleotide encoding the polypeptide. Any leader that is functional in the host cell may be used.

Preferred leaders for filamentous fungal host cells are obtained from the genes for Aspergillus oryzae TAKA amylase and Aspergillus nidulans triose phosphate isomerase.

Suitable leaders for yeast host cells are obtained from the genes for Saccharomyces cerevisiae enolase (ENO-1), Saccharomyces cerevisiae 3-phosphoglycerate kinase, Saccharomyces cerevisiae alpha-factor, and Saccharomyces cerevisiae alcohol dehydrogenase/glyceraldehyde-3-phosphate dehydrogenase (ADH2/GAP).

The control sequence may also be a polyadenylation sequence, a sequence operably linked to the 3'-terminus of the polynucleotide and, when transcribed, is recognized by the host cell as a signal to add polyadenosine residues to transcribed mRNA. Any polyadenylation sequence that is functional in the host cell may be used.

Preferred polyadenylation sequences for filamentous fungal host cells are obtained from the genes for Aspergillus nidulans anthranilate synthase, Aspergillus niger glucoamylase, Aspergillus niger alpha-glucosidase, Aspergillus oryzae TAKA amylase, and Fusarium oxysporum trypsin-like protease.

Useful polyadenylation sequences for yeast host cells are described by Guo and Sherman, 1995, Mol. Cellular Biol. 15: 5983-5990.

The control sequence may also be a signal peptide coding region that encodes a signal peptide linked to the N-terminus of a polypeptide and directs the polypeptide into the cell's secretory pathway. The 5'-end of the coding sequence of the polynucleotide may inherently contain a signal peptide coding sequence naturally linked in translation reading frame with the segment of the coding sequence that encodes the polypeptide. Alternatively, the 5'-end of the coding sequence may contain a signal peptide coding sequence that is heterologous to the coding sequence. A heterologous signal peptide coding sequence may be required where the coding sequence does not naturally contain a signal peptide coding sequence. Alternatively, a heterologous signal peptide coding sequence may simply replace the natural signal peptide coding sequence to enhance secretion of the polypeptide. However, any signal peptide coding sequence that directs the expressed polypeptide into the secretory pathway of a host cell may be used.

Effective signal peptide coding sequences for bacterial host cells are the signal peptide coding sequences obtained from the genes for Bacillus NCIB 11837 maltogenic amylase, Bacillus licheniformis subtilisin, Bacillus licheniformis beta-lactamase, Bacillus stearothermophilus alpha-amylase, Bacillus stearothermophilus neutral proteases (nprT, nprS, nprM), and Bacillus subtilis prsA. Further signal peptides are described by Simonen and Palva, 1993, Microbiol. Rev. 57: 109-137.

Effective signal peptide coding sequences for filamentous fungal host cells are the signal peptide coding sequences obtained from the genes for Aspergillus niger neutral amylase, Aspergillus niger glucoamylase, Aspergillus oryzae TAKA amylase, Humicola insolens cellulase, Humicola insolens endoglucanase V, Humicola lanuginosa lipase, and Rhizomucor miehei aspartic proteinase.

Useful signal peptides for yeast host cells are obtained from the genes for Saccharomyces cerevisiae alpha-factor and Saccharomyces cerevisiae invertase. Other useful signal peptide coding sequences are described by Romanos et al., 1992, supra.

The control sequence may also be a propeptide coding sequence that encodes a propeptide positioned at the N-terminus of a polypeptide. The resultant polypeptide is known as a proenzyme or propolypeptide (or a zymogen in some cases). A propolypeptide is generally inactive and can be converted to an active polypeptide by catalytic or autocatalytic cleavage of the propeptide from the propolypeptide. The propeptide coding sequence may be obtained from the genes for Bacillus subtilis alkaline protease (aprE), Bacillus subtilis neutral protease (nprT), Myceliophthora thermophila laccase (WO 95/33836), Rhizomucor miehei aspartic proteinase, and Saccharomyces cerevisiae alpha-factor.

Mere both signal peptide and propeptide sequences are present, the propeptide sequence is positioned next to the N-terminus of a polypeptide and the signal peptide sequence is positioned next to the N-terminus of the propeptide sequence.

It may also be desirable to add regulatory sequences that regulate expression of the polypeptide relative to the growth of the host cell. Examples of regulatory sequences are those that cause expression of the gene to be turned on or off in response to a chemical or physical stimulus, including the presence of a regulatory compound. Regulatory sequences in prokaryotic systems include the lac, tac, and trp operator systems. In yeast, the ADH2 system or GAL1 system may be used. In filamentous fungi, the *Aspergillus niger* glucoamylase promoter, *Aspergillus oryzae* TAKA alpha-amylase promoter, and *Aspergillus oryzae* glucoamylase promoter, *Trichoderma reesei* cellobiohydrolase I promoter, and *Trichoderma reesei* cellobiohydrolase II promoter may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the polypeptide would be operably linked to the regulatory sequence.

Expression Vectors

The present invention also relates to recombinant expression vectors comprising a polynucleotide of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the polypeptide at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used.

The vector preferably contains one or more selectable markers that permit easy selection of transformed, transfected, transduced, or the like cells. A selectable marker is a gene the product of which provides for biocide or viral resistance, resistance to heavy metals, prototrophy to auxotrophs, and the like.

Examples of bacterial selectable markers are *Bacillus licheniformis* or *Bacillus subtilis* dal genes, or markers that confer antibiotic resistance such as ampicillin, chloramphenicol, kanamycin, neomycin, spectinomycin, or tetracycline resistance. Suitable markers for yeast host cells include, but are not limited to, ADE2, HIS3, LEU2, LYS2, MET3, TRP1, and URA3. Selectable markers for use in a filamentous fungal host cell include, but are not limited to, adeA (phosphoribosylaminoimidazole-succinocarboxamide synthase), adeB (phosphoribosyl-aminoimidazole synthase), amdS (acetamidase), argB (omithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene. Preferred for use in a *Trichoderma* cell are adeA, adeB, amdS, hph, and pyrG genes.

The selectable marker may be a dual selectable marker system as described in WO 2010/039889. In one aspect, the dual selectable marker is a hph-tk dual selectable marker system.

The vector preferably contains an element(s) that permits integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector may further comprise an origin of replication enabling the vector to replicate autonomously in the host cell in question. The origin of replication may be any plasmid replicator mediating autonomous replication that functions in a cell. The term "origin of replication" or "plasmid replicator" means a polynucleotide that enables a plasmid or vector to replicate in vivo.

Examples of bacterial origins of replication are the origins of replication of plasmids pBR322, pUC19, pACYC177, and pACYC184 permitting replication in *E. coli*, and pUB110, pE194, pTA1060, and pAMM1 permitting replication in *Bacillus*.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANS1 (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention may be inserted into a host cell to increase production of a polypeptide. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

Host Cells

The present invention also relates to recombinant host cells, comprising a polynucleotide of the present invention operably linked to one or more control sequences that direct the production of a polypeptide of the present invention. A construct or vector comprising a polynucleotide is introduced into a host cell so that the construct or vector is maintained as a chromosomal integrant or as a self-replicating extra-chromosomal vector as described earlier. The choice of a host cell will to a large extent depend upon the gene encoding the polypeptide and its source.

In some embodiments, the polypeptide is heterologous to the recombinant host cell.

In some embodiments, at least one of the one or more control sequences is heterologous to the polynucleotide encoding the polypeptide.

In some embodiments, the recombinant host cell comprises at least two copies, e.g., three, four, or five, of the polynucleotide of the present invention.

The host cell may be any microbial or plant cell useful in the recombinant production of a polypeptide of the present invention, e.g., a prokaryotic cell or a fungal cell.

The prokaryotic host cell may be any Gram-positive or Gram-negative bacterium. Gram-positive bacteria include, but are not limited to, Bacillus, Clostridium, Enterococcus, Geobacillus, Lactobacillus, Lactococcus, Oceanobacillus, Staphylococcus, Streptococcus, and Streptomyces. Gram-negative bacteria include, but are not limited to, Campylobacter, E. coli, Flavobacterum, Fusobacterum, Helicobacter, Ilyobacter, Neissera, Pseudomonas, Salmonella, and Ureaplasma.

The bacterial host cell may be any Bacillus cell including, but not limited to, Bacillus alkalophilus, Bacillus amyloliquefaciens, Bacillus brews, Bacillus circulans, Bacillus clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis, and Bacillus thuringiensis cells.

The bacterial host cell may also be any Streptococcus cell including, but not limited to, Streptococcus equisimilis, Streptococcus pyogenes, Streptococcus ubers, and Streptococcus equi subsp. Zooepidemicus cells.

The bacterial host cell may also be any Streptomyces cell including, but not limited to, Streptomyces achromogenes, Streptomyces avermitilis, Streptomyces coelicolor, Streptomyces griseus, and Streptomyces lividans cells.

The introduction of DNA into a Bacillus cell may be effected by protoplast transformation (see, e.g., Chang and Cohen, 1979, Mol. Gen. Genet. 168: 111-115), competent cell transformation (see, e.g., Young and Spizizen, 1961, J. Bacteriol. 81: 823-829, or Dubnau and Davidoff-Abelson, 1971, J. Mol. Biol. 56: 209-221), electroporation (see, e.g., Shigekawa and Dower, 1988, Biotechniques 6: 742-751), or conjugation (see, e.g., Koehler and Thome, 1987, J. Bacteriol. 169: 5271-5278). The introduction of DNA into an E. coli cell may be effected by protoplast transformation (see, e.g., Hanahan, 1983, J. Mol. Biol. 166: 557-580) or electroporation (see, e.g., Dower et al., 1988, Nucleic Acids Res. 16: 6127-6145). The introduction of DNA into a Streptomyces cell may be effected by protoplast transformation, electroporation (see, e.g., Gong et al., 2004, Folia Microbiol. (Praha) 49: 399-405), conjugation (see, e.g., Mazodier et al., 1989, J. Bacteriol. 171: 3583-3585), or transduction (see, e.g., Burke et al., 2001, Proc. Natl. Acad. Sci. USA 98: 6289-6294). The introduction of DNA into a Pseudomonas cell may be effected by electroporation (see, e.g., Choi et al., 2006, J. Microbiol. Methods 64: 391-397) or conjugation (see, e.g., Pinedo and Smets, 2005, Appl. Environ. Microbiol. 71: 51-57). The introduction of DNA into a Streptococcus cell may be effected by natural competence (see, e.g., Perry and Kuramitsu, 1981, Infect. Immun. 32: 1295-1297), protoplast transformation (see, e.g., Catt and Jollick, 1991, Microbios 68: 189-207), electroporation (see, e.g., Buckley et al., 1999, Appl. Environ. Microbiol. 65: 3800-3804), or conjugation (see, e.g., Clewell, 1981, Microbiol. Rev. 45:409-436). However, any method known in the art for introducing DNA into a host cell can be used.

The host cell may be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, Ainsworth and Bisby's Dictionary of The Fungi, 8th edition, 1995, CAB International, University Press, Cambridge, UK).

The fungal host cell may be a yeast cell. "Yeast" as used herein includes ascosporogenous yeast (Endomycetales), basidiosporogenous yeast, and yeast belonging to the Fungi Imperfecti (Blastomycetes). Since the classification of yeast may change in the future, for the purposes of this invention, yeast shall be defined as described in Biology and Activities of Yeast (Skinner, Passmore, and Davenport, editors, Soc. App. Bacterol. Symposium Series No. 9, 1980).

The yeast host cell may be a Candida, Hansenula, Kluyveromyces, Pichia, Saccharomyces, Schizosaccharomyces, or Yarrowia cell, such as a Kluyveromyces lactis, Saccharomyces cadsbergensis, Saccharomyces cerevisiae, Saccharomyces diastaticus, Saccharomyces douglasii, Saccharomyces kluyveri, Saccharomyces norbensis, Saccharomyces oviformis, or Yarrowia lipolytica cell.

The fungal host cell may be a filamentous fungal cell. "Filamentous fungi" include all filamentous forms of the subdivision Eumycota and Oomycota (as defined by Hawksworth et al., 1995, supra). The filamentous fungi are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as Saccharomyces cerevisiae is by budding of a unicellular thallus and carbon catabolism may be fermentative.

The filamentous fungal host cell may be an Acremonium, Aspergillus, Aureobasidium, Bjerkandera, Cerporiopsis, Chrysosporium, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phiebia, Piromyces, Pleurotus, Schizophyllum, Talaromyces, Thermoascus, Thielavia, Tolypocladium, Trametes, or Trichoderma cell.

For example, the filamentous fungal host cell may be an Aspergillus awamori, Aspergillus foetidus, Aspergillus fumigatus, Aspergillus japonicus, Aspergillus nidulans,

*Aspergillus niger, Aspergillus oryzae, Bjerkandera adusta, Cerporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Chrysosporium inops, Chrysosporium keratinophilum, Chrysosporium lucknowense, Chrysosporium merdarium, Chrysosporium pannicola, Chrysosponum queenslandicum, Chrysosponum tropicum, Chrysosponum zonatum, Copnnus cinereus, Coriolus hirsutus, Fusanum bactndioides, Fusarium cerealis, Fusanum crookwellense, Fusarium culmorum, Fusarium graminearum, Fusarium graminum, Fusarium heterosporum, Fusanum negundi, Fusarium oxysporum, Fusarium reticulatum, Fusanum roseum, Fusanum sambucinum, Fusarium sarcochroum, Fusarium sporotrichioides, Fusarium suiphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phiebia radiata, Pleurotus eryngii, Talaromyces emersonii, Thielavia terrestris, Trametes villosa, Trametes versicolor, Trichoderma harzianum, Trichoderma koningii, Trichoderma longibrachiatum, Trichoderma reesei,* or *Trichoderma viride* cell.

Fungal cells may be transformed by a process involving protoplast formation, transformation of the protoplasts, and regeneration of the cell wall in a manner known per se. Suitable procedures for transformation of *Aspergillus* and *Trichoderma* host cells are described in EP 238023, Yelton et al., 1984, *Proc. Natl. Acad. Sci. USA* 81: 1470-1474, and Christensen et al., 1988, *Bio/Technology* 6: 1419-1422. Suitable methods for transforming *Fusarium* species are described by Malardier et al., 1989, *Gene* 78: 147-156, and WO 96/00787. Yeast may be transformed using the procedures described by Becker and Guarente, In Abelson, J. N. and Simon, M. I., editors, *Guide to Yeast Genetics and Molecular Biology, Methods in Enzymology*, Volume 194, pp 182-187, Academic Press, Inc., New York; Ito et al., 1983, *J. Bacterol.* 153:163; and Hinnen et al., 1978, *Proc. Natl. Acad. Sci. USA* 75: 1920.

Methods of Production

The present invention also relates to methods of producing a polypeptide of the present invention, comprising (a) cultivating a cell, which in its wild-type form produces the polypeptide, under conditions conducive for production of the polypeptide; and optionally, (b) recovering the polypeptide. In one aspect, the cell is a *Trichoderma, Lecanicillium, Simplicillium, Aspergillus, Comyascus, Acrophialophora, Rhinocladiella, Nemania, Talaromyces, Collariella, Rigidoporous, Loramyces, Fusarium, Gilmaniella, Gliomastix, Albifimbria, Rasamsonia, Hamigera* and/or *Acremonium* cell. In another aspect, the cell is a *Trichoderma harzianum, Trichoderma atroviride, Trichoderma reesei, Trichoderma longipile, Trichoderma koningiopsis, Trichoderma koningii, Trichoderma sinuosum, Lecanicillium primulinum, Simplicillium lameillicola, Aspergillus nidulans, Aspergillus wentii, Comyascus sepedonium, Acrophialophora fusispora, Rhinocladiella* sp., *Nemania serpens, Talaromyces leycettanus, Collariella virescens, Rigidoporous* sp. 74222, and/or *Loramyces macrosporus, Fusarium solani, Gilmaniella humicola, Gliomastix murorum, Albifimbria verrucaria, Rasamsonia byssochlamydoides, Hamigera inflata* and/or *Acremonium exiguum* cell.

The present invention also relates to methods of producing a polypeptide of the present invention, comprising (a) cultivating a recombinant host cell of the present invention under conditions conducive for production of the polypeptide; and optionally, (b) recovering the polypeptide.

The host cells are cultivated in a nutrient medium suitable for production of the polypeptide using methods known in the art. For example, the cells may be cultivated by shake flask cultivation, or small-scale or large-scale fermentation (including continuous, batch, fed-batch, or solid-state fermentations) in laboratory or industrial fermentors in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). If the polypeptide is secreted into the nutrient medium, the polypeptide can be recovered directly from the medium. If the polypeptide is not secreted, it can be recovered from cell lysates.

The polypeptide may be detected using methods known in the art that are specific for the polypeptides. These detection methods include, but are not limited to, use of specific antibodies, formation of an enzyme product, or disappearance of an enzyme substrate. For example, an enzyme assay may be used to determine the activity of the polypeptide The polypeptide may be recovered using methods known in the art. For example, the polypeptide may be recovered from the fermentation medium by conventional procedures including, but not limited to, collection, centrifugation, filtration, extraction, spray-drying, evaporation, or precipitation. In one aspect, a whole fermentation broth comprising the polypeptide is recovered.

The polypeptide may be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., *Protein Purification*, Janson and Ryden, editors, VCH Publishers, New York, 1989) to obtain substantially pure polypeptides.

Beta-Glucanase Granules

The present invention also relates to enzyme granules/particles comprising the beta-glucanases of the invention. In an embodiment, the granule comprises a core, and optionally one or more coatings (outer layers) surrounding the core.

The core may have a diameter, measured as equivalent spherical diameter (volume based average particle size), of 20-2000 μm, particularly 50-1500 μm, 100-1500 μm or 250-1200 μm.

In an embodiment, the core comprises one or more polypeptides having beta-1,6-glucanase activity of the present invention. In an embodiment, the core comprises one or more polypeptides having endo- and/or exo-beta-1,3-glucanase activity of the present invention. In an embodiment, the core comprises one or more polypeptides having beta-1,6-glucanase activity and/or one or more polypeptides having endo- and/or exo-beta-1,3-glucanase activity of the present invention.

The core may include additional materials such as fillers, fiber materials (cellulose or synthetic fibers), stabilizing agents, solubilizing agents, suspension agents, viscosity regulating agents, light spheres, plasticizers, salts, lubricants and fragrances.

The core may include a binder, such as synthetic polymer, wax, fat, or carbohydrate.

The core may include a salt of a multivalent cation, a reducing agent, an antioxidant, a peroxide decomposing catalyst and/or an acidic buffer component, typically as a homogenous blend.

The core may include an inert particle with the enzyme absorbed into it, or applied onto the surface, e.g., by fluid bed coating.

The core may have a diameter of 20-2000 μm, particularly 50-1500 μm, 100-1500 μm or 250-1200 μm.

The core may be surrounded by at least one coating, e.g., to improve the storage stability, to reduce dust formation during handling, or for coloring the granule. The optional coating(s) may include a salt coating, or other suitable coating materials, such as polyethylene glycol (PEG), methyl hydroxy-propyl cellulose (MHPC) and polyvinyl alcohol (PVA).

The coating may be applied in an amount of at least 0.1% by weight of the core, e.g., at least 0.5%, at least 1%, at least 5%, at least 10%, or at least 15%. The amount may be at most 100%, 70%, 50%, 40% or 30%.

The coating is preferably at least 0.1 μm thick, particularly at least 0.5 μm, at least 1 μm or at least 5 μm. In some embodiments, the thickness of the coating is below 100 μm, such as below 60 μm, or below 40 μm.

The coating should encapsulate the core unit by forming a substantially continuous layer. A substantially continuous layer is to be understood as a coating having few or no holes, so that the core unit it is encapsulating/enclosing has few or none uncoated areas. The layer or coating should, in particular, be homogeneous in thickness.

The coating can further contain other materials as known in the art, e.g., fillers, antisticking agents, pigments, dyes, plasticizers and/or binders, such as titanium dioxide, kaolin, calcium carbonate or talc.

A salt coating may comprise at least 60% by weight of a salt, e.g., at least 65%, at least 70%, at least 75%, at least 80%, at least 85%, at least 90%, at least 95% or at least 99% by weight.

To provide acceptable protection, the salt coating is preferably at least 0.1 μm thick, e.g., at least 0.5 μm, at least 1 μm, at least 2 μm, at least 4 μm, at least 5 μm, or at least 8 μm. In a particular embodiment, the thickness of the salt coating is below 100 μm, such as below 60 μm, or below 40 μm.

The salt may be added from a salt solution where the salt is completely dissolved or from a salt suspension wherein the fine particles are less than 50 μm, such as less than 10 μm or less than 5 μm.

The salt coating may comprise a single salt or a mixture of two or more salts. The salt may be water soluble, in particular, having a solubility at least 0.1 g in 100 g of water at 20° C., preferably at least 0.5 g per 100 g water, e.g., at least 1 g per 100 g water, e.g., at least 5 g per 100 g water.

The salt may be an inorganic salt, e.g., salts of sulfate, sulfite, phosphate, phosphonate, nitrate, chloride or carbonate or salts of simple organic acids (less than 10 carbon atoms, e.g., 6 or less carbon atoms) such as citrate, malonate or acetate. Examples of cations in these salts are alkali or earth alkali metal ions, the ammonium ion or metal ions of the first transition series, such as sodium, potassium, magnesium, calcium, zinc or aluminum. Examples of anions include chloride, bromide, iodide, sulfate, sulfite, bisulfite, thiosulfate, phosphate, monobasic phosphate, dibasic phosphate, hypophosphite, dihydrogen pyrophosphate, tetraborate, borate, carbonate, bicarbonate, metasilicate, citrate, malate, maleate, malonate, succinate, lactate, formate, acetate, butyrate, propionate, benzoate, tartrate, ascorbate or gluconate. In particular, alkali- or earth alkali metal salts of sulfate, sulfite, phosphate, phosphonate, nitrate, chloride or carbonate or salts of simple organic acids such as citrate, malonate or acetate may be used.

The salt in the coating may have a constant humidity at 20° C. above 60%, particularly above 70%, above 80% or above 85%, or it may be another hydrate form of such a salt (e.g., anhydrate). The salt coating may be as described in WO 00/01793 or WO 2006/034710. Specific examples of suitable salts are NaCl ($CH_{20° C.}$=76%), $Na_2CO_3$ ($CH_{20° C.}$=92%), $NaNO_3$ ($CH_{20° C.}$=73%), $Na_2HPO_4$ ($CH_{20° C.}$=95%), $Na_3PO_4$ ($CH_{20° C.}$=92%), $NH_4Cl$ ($CH_{20° C.}$=79.5%), $(NH_4)_2HPO_4$ ($CH_{20° C.}$=93.0%), $NH_4H_2PO_4$ ($CH_{20° C.}$=93.1%), $(NH_4)_2SO_4$ ($CH_{20° C.}$=81.1%), KCl ($CH_{20° C.}$=85%), $K_2HPO_4$ ($CH_{20° C.}$=92%), $KH_2PO_4$ ($CH_{20° C.}$=96.5%), $KNO_3$ ($CH_{20° C.}$=93.5%), $Na_2SO_4$ ($CH_{20° C.}$=93%), $K_2SO_4$ ($CH_{20° C.}$=98%), $KHSO_4$ ($CH_{20° C.}$=86%), $MgSO_4$ ($CH_{20° C.}$=90%), $ZnSO_4$ ($CH_{20° C.}$=90%) and sodium citrate ($CH_{20° C.}$=86%). Other examples include $NaH_2PO_4$, $(NH_4)H_2PO_4$, $CuSO_4$, $Mg(NO_3)_2$ and magnesium acetate.

The salt may be in anhydrous form, or it may be a hydrated salt, i.e. a crystalline salt hydrate with bound water(s) of crystallization, such as described in WO 99/32595. Specific examples include anhydrous sodium sulfate ($Na_2SO_4$), anhydrous magnesium sulfate ($MgSO_4$), magnesium sulfate heptahydrate ($MgSO_4 \cdot 7H_2O$), zinc sulfate heptahydrate ($ZnSO_4 \cdot 7H_2O$), sodium phosphate dibasic heptahydrate ($Na_2HPO_4 \cdot 7H_2O$), magnesium nitrate hexahydrate ($Mg(NO_3)_2(6H_2O)$), sodium citrate dihydrate and magnesium acetate tetrahydrate.

Preferably the salt is applied as a solution of the salt, e.g., using a fluid bed.

The coating materials can be waxy coating materials and film-forming coating materials. Examples of waxy coating materials are poly(ethylene oxide) products (polyethyleneglycol, PEG) with mean molar weights of 1000 to 20000; ethoxylated nonylphenols having from 16 to 50 ethylene oxide units; ethoxylated fatty alcohols in which the alcohol contains from 12 to 20 carbon atoms and in which there are 15 to 80 ethylene oxide units; fatty alcohols; fatty acids; and mono- and di- and triglycerides of fatty acids. Examples of film-forming coating materials suitable for application by fluid bed techniques are given in GB 1483591.

The granule may optionally have one or more additional coatings. Examples of suitable coating materials are polyethylene glycol (PEG), methyl hydroxy-propyl cellulose (MHPC) and polyvinyl alcohol (PVA). Examples of enzyme granules with multiple coatings are described in WO 93/07263 and WO 97/23606.

The core can be prepared by granulating a blend of the ingredients, e.g., by a method comprising granulation techniques such as crystallization, precipitation, pan-coating, fluid bed coating, fluid bed agglomeration, rotary atomization, extrusion, prilling, spheronization, size reduction methods, drum granulation, and/or high shear granulation.

Methods for preparing the core can be found in the Handbook of Powder Technology; Particle size enlargement by C. E. Capes; Volume 1; 1980; Elsevier. Preparation methods include known feed and granule formulation technologies, e.g.:

(a) Spray dried products, wherein a liquid enzyme-containing solution is atomized in a spray drying tower to form small droplets which during their way down the drying tower dry to form an enzyme-containing particulate material. Very small particles can be produced this way (Michael S. Showell (editor); *Powdered detergents*; Surfactant Science Series; 1998; vol. 71; page 140-142; Marcel Dekker).

(b) Layered products, wherein the enzyme is coated as a layer around a pre-formed inert core particle, wherein an enzyme-containing solution is atomized, typically in a fluid bed apparatus wherein the pre-formed core particles are fluidized, and the enzyme-containing solution adheres to the core particles and dries up to leave a layer of dry enzyme on the surface of the core particle. Particles of a desired size can be obtained this way if a useful core particle of the desired size can be found. This type of product is described in, e.g., WO 97/23606.

(c) Absorbed core particles, wherein rather than coating the enzyme as a layer around the core, the enzyme is absorbed onto and/or into the surface of the core. Such a process is described in WO 97/39116.

(d) Extrusion or pelletized products, wherein an enzyme-containing paste is pressed to pellets or under pressure is extruded through a small opening and cut into particles which are subsequently dried. Such particles usually have a considerable size because of the material in which the extrusion opening is made (usually a plate with bore holes) sets a limit on the allowable pressure drop over the extrusion opening. Also, very high extrusion pressures when using a small opening increase heat generation in the enzyme paste, which is harmful to the enzyme (Michael S. Showell (editor); *Powdered detergents*; Surfactant Science Series; 1998; vol. 71; pages 140-142; Marcel Dekker).

(e) Prilled products, wherein an enzyme-containing powder is suspended in molten wax and the suspension is sprayed, e.g., through a rotating disk atomizer, into a cooling chamber where the droplets quickly solidify (Michael S. Showell (editor); *Powdered detergents*; Surfactant Science Series; 1998; vol. 71; page 140-142; Marcel Dekker). The product obtained is one wherein the enzyme is uniformly distributed throughout an inert material instead of being concentrated on its surface. U.S. Pat. Nos. 4,016,040 and 4,713,245 describe this technique.

(f) Mixer granulation products, wherein an enzyme-containing liquid is added to a dry powder composition of conventional granulating components. The liquid and the powder in a suitable proportion are mixed and as the moisture of the liquid is absorbed in the dry powder, the components of the dry powder will start to adhere and agglomerate and particles will build up, forming granulates comprising the enzyme. Such a process is described in U.S. Pat. No. 4,106,991 and related documents EP 170360, EP 304332, EP 304331, WO 90/09440 and WO 90/09428. In a particular product of this process, various high-shear mixers can be used as granulators. Granulates consisting of enzyme, fillers and binders etc. are mixed with cellulose fibers to reinforce the particles to produce a so-called T-granulate. Reinforced particles, are more robust, and release less enzymatic dust.

(g) Size reduction, wherein the cores are produced by milling or crushing of larger particles, pellets, tablets, briquettes etc. containing the enzyme. The wanted core particle fraction is obtained by sieving the milled or crushed product. Over and undersized particles can be recycled. Size reduction is described in Martin Rhodes (editor); *Principles of Powder Technology*; 1990; Chapter 10; John Wiley & Sons.

(h) Fluid bed granulation. Fluid bed granulation involves suspending particulates in an air stream and spraying a liquid onto the fluidized particles via nozzles. Particles hit by spray droplets get wetted and become tacky. The tacky particles collide with other particles and adhere to them to form a granule.

(i) The cores may be subjected to drying, such as in a fluid bed drier. Other known methods for drying granules in the feed or enzyme industry can be used by the skilled person. The drying preferably takes place at a product temperature of from 25 to 90° C. For some enzymes, it is important the cores comprising the enzyme contain a low amount of water before coating with the salt. If water sensitive enzymes are coated with a salt before excessive water is removed, it will be trapped within the core and may affect the activity of the enzyme negatively. After drying, the cores preferably contain 0.1-10% w/w water.

Non-dusting granulates may be produced, e.g., as disclosed in U.S. Pat. Nos. 4,106,991 and 4,661,452 and may optionally be coated by methods known in the art.

The granulate may further one or more additional enzymes. Each enzyme will then be present in more granules securing a more uniform distribution of the enzymes, and also reduces the physical segregation of different enzymes due to different particle sizes. Methods for producing multi-enzyme co-granulates is disclosed in the ip.com disclosure IPCOM000200739D. Another example of formulation of enzymes by the use of co-granulates is disclosed in WO 2013/188331.

The present invention also relates to protected enzymes prepared according to the method disclosed in EP 238,216.

In an embodiment, the granule further comprises one or more additional enzymes, e.g., hydrolase, isomerase, ligase, lyase, oxidoreductase, and transferase. The one or more additional enzymes are preferably selected from the group consisting of acetylxylan esterase, acylglycerol lipase, amylase, alpha-amylase, beta-amylase, arabinofuranosidase, cellobiohydrolases, cellulase, feruloyl esterase, galactanase, alpha-galactosidase, beta-galactosidase, beta-glucanase, beta-glucosidase, lysophospholipase, lysozyme, alpha-mannosidase, beta-mannosidase (mannanase), phytase, phospholipase A1, phospholipase A2, phospholipase D, protease, pullulanase, pectin esterase, triacylglycerol lipase, xylanase, beta-xylosidase or any combination thereof.

Liquid Formulations

The present invention also relates to liquid compositions comprising the beta-glucanases of the invention. The composition may comprise an enzyme stabilizer (examples of which include polyols such as propylene glycol or glycerol, sugar or sugar alcohol, lactic acid, reversible protease inhibitor, boric acid, or a boric acid derivative, e.g., an aromatic borate ester, or a phenyl boronic acid derivative such as 4-formylphenyl boronic acid).

In some embodiments, filler(s) or carrier material(s) are included to increase the volume of such compositions. Suitable filler or carrier materials include, but are not limited to, various salts of sulfate, carbonate and silicate as well as talc, clay and the like. Suitable filler or carrier materials for liquid compositions include, but are not limited to water or low molecular weight primary and secondary alcohols including polyols and diols. Examples of such alcohols include, but are not limited to, methanol, ethanol, propanol and isopropanol. In some embodiments, the compositions contain from about 5% to about 90% of such materials.

In an aspect, the present invention relates to liquid formulations comprising:

(A) 0.001% to 25% w/w of one or more polypeptides having beta-1,6-glucanase activity of the present invention; and (B) water.

In an aspect, the present invention relates to liquid formulations comprising:

(A) 0.001% to 25% w/w of one or more polypeptides having exo- and/or endo-beta-1,3-glucanase activity of the present invention; and
(B) water.

In an aspect, the present invention relates to liquid formulations comprising:
(A) 0.001% to 25% w/w of one or more polypeptides having beta-1,6-glucanase activity and/or one or more polypeptides having exo- and/or endo-beta-1,3-glucanase activity of the present invention; and
(B) water.

In another embodiment, the liquid formulation comprises 20% to 80% w/w of polyol. In one embodiment, the liquid formulation comprises 0.001% to 2.0% w/w preservative.

In another embodiment, the invention relates to liquid formulations comprising:
(A) 0.001% to 25% w/w of one or more polypeptides having beta-1,6-glucanase activity of the present invention;
(B) 20% to 80% w/w of polyol;
(C) optionally 0.001% to 2.0% w/w preservative; and
(D) water.

In another embodiment, the invention relates to liquid formulations comprising:
(A) 0.001% to 25% w/w of one or more polypeptides having exo- and/or endo-beta-1,3-glucanase activity of the present invention;
(B) 20% to 80% w/w of polyol;
(C) optionally 0.001% to 2.0% w/w preservative; and
(D) water.

In another embodiment, the invention relates to liquid formulations comprising:
(A) 0.001% to 25% w/w of one or more polypeptides having beta-1,6-glucanase activity and/or one or more polypeptides having exo- and/or endo-beta-1,3-glucanase activity of the present invention;
(B) 20% to 80% w/w of polyol;
(C) optionally 0.001% to 2.0% w/w preservative; and
(D) water.

In another embodiment, the invention relates to liquid formulations comprising:
(A) 0.001% to 25% w/w of one or more polypeptides having beta-1,6-glucanase activity of the present invention;
(B) 0.001% to 2.0% w/w preservative;
(C) optionally 20% to 80% w/w of polyol; and
(D) water.

In another embodiment, the invention relates to liquid formulations comprising:
(A) 0.001% to 25% w/w of one or more polypeptides having exo- and/or endo-beta-1,3-glucanase activity of the present invention;
(B) 0.001% to 2.0% w/w preservative;
(C) optionally 20% to 80% w/w of polyol; and
(D) water.

In another embodiment, the invention relates to liquid formulations comprising:
(A) 0.001% to 25% w/w of one or more polypeptides having beta-1,6-glucanase activity and/or one or more polypeptides having exo- and/or endo-beta-1,3-glucanase activity of the present invention;
(B) 0.001% to 2.0% w/w preservative;
(C) optionally 20% to 80% w/w of polyol; and
(D) water.

In another embodiment, the liquid formulation comprises one or more formulating agents, such as a formulating agent selected from the group consisting of polyol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch, PVA, acetate and phosphate, preferably selected from the group consisting of sodium sulfate, dextrin, cellulose, sodium thiosulfate, kaolin and calcium carbonate. In one embodiment, the polyols is selected from the group consisting of glycerol, sorbitol, propylene glycol (MPG), ethylene glycol, diethylene glycol, triethylene glycol, 1,2-propylene glycol or 1,3-propylene glycol, dipropylene glycol, polyethylene glycol (PEG) having an average molecular weight below about 600 and polypropylene glycol (PPG) having an average molecular weight below about 600, more preferably selected from the group consisting of glycerol, sorbitol and propylene glycol (MPG) or any combination thereof.

In another embodiment, the liquid formulation comprises 20%-80% polyol (i.e., total amount of polyol), e.g., 25%-75% polyol, 30%-70% polyol, 35%-65% polyol, or 40%-60% polyol. In one embodiment, the liquid formulation comprises 20%-80% polyol, e.g., 25%-75% polyol, 30%-70% polyol, 35%-65% polyol, or 40%-60% polyol, wherein the polyol is selected from the group consisting of glycerol, sorbitol, propylene glycol (MPG), ethylene glycol, diethylene glycol, triethylene glycol, 1,2-propylene glycol or 1,3-propylene glycol, dipropylene glycol, polyethylene glycol (PEG) having an average molecular weight below about 600 and polypropylene glycol (PPG) having an average molecular weight below about 600. In one embodiment, the liquid formulation comprises 20%-80% polyol (i.e., total amount of polyol), e.g., 25%-75% polyol, 30%-70% polyol, 35%-65% polyol, or 40%-60% polyol, wherein the polyol is selected from the group consisting of glycerol, sorbitol and propylene glycol (MPG).

In another embodiment, the preservative is selected from the group consisting of sodium sorbate, potassium sorbate, sodium benzoate and potassium benzoate or any combination thereof. In one embodiment, the liquid formulation comprises 0.02% to 1.5% w/w preservative, e.g., 0.05% to 1.0% w/w preservative or 0.1% to 0.5% w/w preservative. In one embodiment, the liquid formulation comprises 0.001% to 2.0% w/w preservative (i.e., total amount of preservative), e.g., 0.02% to 1.5% w/w preservative, 0.05% to 1.0% w/w preservative, or 0.1% to 0.5% w/w preservative, wherein the preservative is selected from the group consisting of sodium sorbate, potassium sorbate, sodium benzoate and potassium benzoate or any combination thereof.

In another embodiment, the liquid formulation further comprises one or more additional enzymes, e.g., hydrolase, isomerase, ligase, lyase, oxidoreductase, and transferase. The one or more additional enzymes are preferably selected from the group consisting of acetylxylan esterase, acylglycerol lipase, amylase, alpha-amylase, beta-amylase, arabinofuranosidase, cellobiohydrolases, cellulase, feruloyl esterase, galactanase, alpha-galactosidase, beta-galactosidase, beta-glucanase, beta-glucosidase, lysophospholipase, lysozyme, alpha-mannosidase, beta-mannosidase (mannanase), phytase, phospholipase A1, phospholipase A2, phospholipase D, protease, pullulanase, pectin esterase, triacylglycerol lipase, xylanase, beta-xylosidase or any combination thereof.

Fermentation Broth Formulations or Cell Compositions

The present invention also relates to a fermentation broth formulation or a cell composition comprising a polypeptide of the present invention. The fermentation broth formulation or the cell composition further comprises additional ingredients used in the fermentation process, such as, for example, cells (including, the host cells containing the gene encoding the polypeptide of the present invention which are used to produce the polypeptide of interest), cell debris, biomass, fermentation media and/or fermentation products. In some embodiments, the composition is a cell-killed whole broth containing organic acid(s), killed cells and/or cell debris, and culture medium.

The term "fermentation broth" as used herein refers to a preparation produced by cellular fermentation that undergoes no or minimal recovery and/or purification. For example, fermentation broths are produced when microbial cultures are grown to saturation, incubated under carbon-limiting conditions to allow protein synthesis (e.g., expression of enzymes by host cells) and secretion into cell culture medium. The fermentation broth can contain unfractionated or fractionated contents of the fermentation materials derived at the end of the fermentation. Typically, the fermentation broth is unfractionated and comprises the spent culture medium and cell debris present after the microbial cells (e.g., filamentous fungal cells) are removed, e.g., by centrifugation. In some embodiments, the fermentation broth contains spent cell culture medium, extracellular enzymes, and viable and/or nonviable microbial cells.

In some embodiments, the fermentation broth formulation or the cell composition comprises a first organic acid component comprising at least one 1-5 carbon organic acid and/or a salt thereof and a second organic acid component comprising at least one 6 or more carbon organic acid and/or a salt thereof. In some embodiments, the first organic acid component is acetic acid, formic acid, propionic acid, a salt thereof, or a mixture of two or more of the foregoing and the second organic acid component is benzoic acid, cyclohexanecarboxylic acid, 4-methylvaleric acid, phenylacetic acid, a salt thereof, or a mixture of two or more of the foregoing.

In one aspect, the composition contains an organic acid(s), and optionally further contains killed cells and/or cell debris. In some embodiments, the killed cells and/or cell debris are removed from a cell-killed whole broth to provide a composition that is free of these components.

The fermentation broth formulation or cell composition may further comprise a preservative and/or anti-microbial (e.g., bacteriostatic) agent, including, but not limited to, sorbitol, sodium chloride, potassium sorbate, and others known in the art.

The cell-killed whole broth or composition may contain the unfractionated contents of the fermentation materials derived at the end of the fermentation. Typically, the cell-killed whole broth or composition contains the spent culture medium and cell debris present after the microbial cells (e.g., filamentous fungal cells) are grown to saturation, incubated under carbon-limiting conditions to allow protein synthesis. In some embodiments, the cell-killed whole broth or composition contains the spent cell culture medium, extracellular enzymes, and killed filamentous fungal cells. In some embodiments, the microbial cells present in the cell-killed whole broth or composition can be permeabilized and/or lysed using methods known in the art.

A whole broth or cell composition as described herein is typically a liquid, but may contain insoluble components, such as killed cells, cell debris, culture media components, and/or insoluble enzyme(s). In some embodiments, insoluble components may be removed to provide a clarified liquid composition.

The whole broth formulations and cell composition of the present invention may be produced by a method described in WO 90/15861 or WO 2010/096673.

Uses

The polypeptides having beta-glucanase activity (beta-1,6-glucanase activity and/or exo- and/or endo-beta-1,3-glucanase activity) may be used in applications where beta-glucan (e.g., beta-D-glucan, including $(1\rightarrow6)$-β-D-glucans, $(1\rightarrow3)$-β-D-glucans, and/or mixed-link $(1\rightarrow3,1\rightarrow4)$-s-D-glucans, for example in cereal grains, such as corn, wheat, rice, oats, and barley, needs to be degraded (e.g., under acidic conditions). Accordingly, aspects of the present invention relate to use of the polypeptides having beta-glucanase activity (beta-1,6-glucanase activity and/or exo- and/or endo-beta-1,3-glucanase activity) for degrading beta-glucan and processes of degrading a beta-glucan comprising contacting the beta-glucan with at least one polypeptide having beta-1,6-glucanase activity and/or exo- and/or endo-beta-1,3-glucanase activity.

Preferably, the beta-glucan degraded in a use or process of the present invention is a beta-D-glucan, for example $(1\rightarrow6)$-β-D-glucans, $(1\rightarrow3)$-β-D-glucans, and/or mixed-link $(1\rightarrow3,1\rightarrow4)$-β-D-glucans, more preferably wherein said beta-glucan is a cereal beta-glucan, such as corn, wheat, rice, oats, and barley, wherein the process is carried out under acidic conditions having pH of 7.5 or less using polypeptides having beta-glucanase activity (beta-1,6-glucanase activity and/or exo- and/or endo-beta-1,3-glucanase activity) that are stable and active under those conditions.

In one aspect, the process of degrading a beta-glucan is a process for producing a fermentation product from starch-containing material, wherein a partially degraded starch-containing material containing beta-glucan is contacted with at least one polypeptide having beta-1,6-glucanase activity and/or exo- and/or endo-beta-1,3-glucanase activity during saccharification, fermentation, or simultaneous saccharification and fermentation using a fermenting organism to produce the fermentation product.

In another aspect, at least one polypeptide having beta-1,6-glucanase activity and/or exo- and/or endo-beta-1,3-glucanase activity is used for degrading a beta-glucan during a process for producing a fermentation product from starch-containing material by contacting a partially degraded starch-containing material containing beta-glucan with at least one polypeptide having beta-1,6-glucanase activity and/or exo- and/or endo-beta-1,3-glucanase activity during saccharification, fermentation, or simultaneous saccharification and fermentation using a fermenting organism to produce the fermentation product.

The starch-containing material may be partially degraded prior to saccharification, fermentation, or simultaneous saccharification and fermentation via liquefaction at high temperatures (e.g., above the gelatinization temperature of the starch-containing material) using one or more thermostable enzymes, such as thermostable alpha-amylases, proteases, phytases, endoglucanases, pullulanases, glucoamylases, and/or xylanases. For example, the liquefaction may be carried out when corn is the starch-containing material at a temperature range of 70-100 degrees Celsius inclusive. The starch-containing material may be partially degraded during saccharification, fermentation, or simultaneous saccharification at temperatures below the gelatinization using glucoamylase and alpha-amylase in a raw-starch hydrolysis process, in which the at least one polypeptide having beta-glucanase activity (beta-1,6-glucanase activity and/or exo- and/or endo-beta-1,3-glucanase activity) is contacted with the starch-containing material as it is being partially degraded.

In an embodiment, the at least one polypeptide having beta-1,6-glucanase activity and/or endo- and/or exo-beta-1,3-glucanase activity has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, at least one polypeptide having beta-1,6-glucanase activity, e.g., from the GH30_3 family, GH5_15 family, and/or GH131 family, having a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5, is used to degrade beta-glucan, for example, by contacting a beta-glucan during the saccharification, fermentation, or simultaneous saccharification and fermentation step of a process for producing a fermentation product from a starch-containing material (e.g., the production of alcohol, such as fuel ethanol, from corn). In an embodiment, at least one polypeptide having beta-1,3-glucanase activity, e.g., from the GH16, GH55_3, GH64 and GH131, having a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5, is used to degrade beta-glucan, for example, by contacting a beta-glucan during the saccharification, fermentation, or simultaneous saccharification and fermentation step of a process for producing a fermentation product from a starch-containing material (e.g., the production of alcohol, such as fuel ethanol, from corn).

In an embodiment, at least one polypeptide having beta-1,6-glucanase activity and/or endo- and/or exo-beta-1,3-glucanase activity has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, at least one polypeptide having beta-1,6-glucanase activity, e.g., from the GH30_3 family, GH5_15 family, and/or GH131 family, having an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5, is used to degrade beta-glucan, for example, by contacting a beta-glucan during the saccharification, fermentation, or simultaneous saccharification and fermentation step of a process for producing a fermentation product from a starch-containing material (e.g., the production of alcohol, such as fuel ethanol, from corn). In an embodiment, at least one polypeptide having beta-1,3-glucanase activity, e.g., from the GH16, GH55_3, GH64 and GH131, having an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5, is used to degrade beta-glucan, for example, by contacting a beta-glucan during the saccharification, fermentation, or simultaneous saccharification and fermentation step of a process for producing a fermentation product from a starch-containing material (e.g., the production of alcohol, such as fuel ethanol, from corn).

Such polypeptides having beta-glucanase activity (beta-1,6-glucanase activity and/or exo- and/or endo-beta-1,3-glucanase activity) for degrading beta-glucan, for example in a process of the invention, preferably are selected from the group consisting of: (a) polypeptides having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153, which have beta-1,6-glucanase activity and/or exo- and/or endo-beta-1,3-glucanase activity; (b) polypeptides having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to the sequence of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, SEQ ID NO: 120, SEQ ID NO: 145, SEQ ID NO: 148, SEQ ID NO: 151, or SEQ ID NO: 154 which have beta-1,6-glucanase activity and/or exo- and/or endo-beta-1,3-glucanase activity; (c) polypeptides having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to a mature polypeptide of SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, or SEQ ID NO: 107, SEQ ID NO: 110, SEQ ID NO: 113, SEQ ID NO: 116, SEQ ID NO: 119, SEQ ID NO: 144, SEQ ID NO: 147, SEQ ID NO: 150, or SEQ ID NO: 153, which have beta-1,6-glucanase activity and/or exo- and/or endo-beta-1,3-glucanase activity; (d) polypeptides encoded by a polynucleotide that hybridizes under medium, medium-high, high, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152, or the cDNA sequences thereof, which have beta-1,6-glucanase activity and/or exo- and/or endo-beta-1,3-glucanase activity; (e) polypeptides encoded by a polynucleotide having at least 60%, at least 65%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, or 100% sequence identity to the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, or SEQ ID NO: 88, SEQ ID NO: 91, SEQ ID NO: 94, SEQ ID NO: 97, SEQ ID NO: 100, SEQ ID NO: 103, or SEQ ID NO: 106, SEQ ID NO: 109, SEQ ID NO: 112, SEQ ID NO: 115, SEQ ID NO: 118, SEQ ID NO: 143, SEQ ID NO: 146, SEQ ID NO: 149, or SEQ ID NO: 152, or the cDNA sequences thereof, which have beta-1,6-glucanase activity and/or exo- and/or endo-beta-1,3-glucanase activity; and (f) fragments of (a), (b), (c), (d), and/or (e) that have beta-1,6-glucanase activity and/or exo- and/or endo-beta-1, 3-glucanase activity. The uses and processes of the present invention contemplate using at least one polypeptide as described above as a mono-component, in a composition of the present invention comprising the at least one polypeptide and at least one additional enzyme, or in recombinant host cells (e.g., recombinant yeast host cells) comprising at least one heterologous polynucleotide expressing the at least one polypeptide. The recombinant yeast host cell can be used during fermentation or SSF for in situ expression of the at least one polypeptide to replace (i.e., eliminate) or reduce exogenous addition of the at least one polypeptide during a process for producing a fermentation product (e.g., fuel ethanol).

Aspects of the present invention relate to processes of producing fermentation products, such as ethanol, from starch-containing material or a cellulosic-containing material, using a fermenting organism.

Processes for Producing Fermentation Products from Un-Gelatinized Starch-Containing Material.

The invention relates to processes for producing fermentation products from starch-containing material without gelatinization (i.e., without cooking) of the starch-containing material (often referred to as a "raw starch hydrolysis" process). The fermentation product, such as ethanol, can be produced without liquefying the aqueous slurry containing the starch-containing material and water. In one embodiment a process of the invention includes saccharifying (e.g., milled) starch-containing material, e.g., granular starch, below the initial gelatinization temperature, preferably in the presence of an alpha-amylase and carbohydrate-source generating enzyme(s) to produce sugars that can be fermented into the fermentation product by a suitable fermenting organism. In this embodiment the desired fermentation product, e.g., ethanol, is produced from un-gelatinized (i.e., uncooked), preferably milled, cereal grains, such as corn.

Processes for producing a fermentation product from starch-containing material may comprise simultaneously saccharifying and fermenting starch-containing material using a carbohydrate-source generating enzymes and a fermenting organism at a temperature below the initial gelatinization temperature of said starch-containing material in the presence of an alpha-amylase of the invention. Saccharification and fermentation may also be separate.

In an aspect, the invention relates to processes for producing fermentation products, preferably ethanol, from starch-containing material comprising the steps of:
  i) saccharifying the starch-containing material using a carbohydrate-source generating enzyme at a temperature below the initial gelatination temperature; and
  ii) fermenting using a fermenting organism;
  wherein at least one polypeptide having beta-1,6-glucanase activity and/or at least one polypeptide having endo- and/or exo-beta-1,3-glucanase activity are present or added during saccharification, fermentation or simultaneous saccharification and fermentation.

In an embodiment, the invention relates to processes for producing fermentation products from starch-containing material comprising the steps of:
  i) saccharifying the starch-containing material using a carbohydrate-source generating enzyme at a temperature below the initial gelatination temperature; and
  ii) fermenting using a fermenting organism;
  wherein at least one polypeptide having endo-beta-1,3-glucanase activity and/or at least one polypeptide having exo-beta-1,3-glucanase activity are present or added during saccharification, fermentation or simultaneous saccharification and fermentation.

In an embodiment, the invention relates to processes for producing fermentation products, preferably ethanol, from starch-containing material comprising the steps of:
  i) saccharifying the starch-containing material using a carbohydrate-source generating enzyme at a temperature below the initial gelatination temperature; and
  ii) fermenting using a fermenting organism;
  wherein at least one polypeptide having beta-1,6-glucanase activity and/or endo- and/or exo-beta-1,3-glucanase activity is present or added during saccharification, fermentation or simultaneous saccharification and fermentation. In some embodiments, at least two, at least three, at least four, or at least five polypeptides having beta-1,6-glucanase activity and/or endo- and/or exo-beta-1,3-glucanase activity are present and/or added during saccharification, fermentation or simultaneous saccharification and fermentation.

In an embodiment, the invention relates to processes for producing fermentation products from starch-containing material comprising the steps of:
ii) saccharifying the starch-containing material using a carbohydrate-source generating enzyme at a temperature below the initial gelatination temperature; and
iii) fermenting using a fermenting organism;
wherein at least one polypeptide having endo-beta-1,3-glucanase activity and/or exo-beta-1,3-glucanase activity are present or added during saccharification, fermentation or simultaneous saccharification and fermentation. In some embodiments, at least two, at least three, at least four, or at least five polypeptides having endo-beta-1,3-glucanase activity and/or exo-beta-1,3-glucanase activity are present and/or added during saccharification, fermentation or simultaneous saccharification and fermentation.

The at least one polypeptide having beta-1,6-glucanase activity and/or endo- and/or exo-beta-1,3-glucanasee activity present or added in the above described processes for producing fermentation products from starch-containing material may be added exogenously during saccharification, fermentation or simultaneous saccharification and fermentation as mono-components, as enzyme blends or compositions comprising the beta-glucanases, and/or via in-situ expression and secretion of the beta-glucanases by the fermenting organism, e.g., a recombinant host cell or fermenting organism described herein (e.g., yeast, such as from the genus *Saccharomyces*, preferably *Saccharomyces cerevisiae*).

Processes for Producing Fermentation Products from Gelatinized Starch-Containing Material In this aspect, the invention relates to processes for producing fermentation products, especially ethanol, from starch-containing material, which process includes a liquefaction step and sequentially or simultaneously performed saccharification and fermentation steps.

Consequently, the invention relates to processes for producing fermentation products from starch-containing material comprising the steps of:
i) liquefying the starch-containing material at a temperature above the initial gelatinization temperature using an alpha-amylase;
ii) saccharifying using a carbohydrate-source generating enzyme; and
iii) fermenting using a fermenting organism;
wherein at least one polypeptide having beta-1,6-glucanase activity and/or at least one polypeptide having endo- and/or exo-beta-1,3-glucanase activity are present or added during saccharification, fermentation or simultaneous saccharification and fermentation.

In an embodiment, the invention relates to processes for producing fermentation products from starch-containing material comprising the steps of:
i) liquefying the starch-containing material at a temperature above the initial gelatinization temperature using an alpha-amylase;
ii) saccharifying using a carbohydrate-source generating enzyme; and
iii) fermenting using a fermenting organism;
wherein at least one polypeptide having endo-beta-1,3-glucanase activity and/or at least one polypeptide having exo-beta-1,3-glucanase activity are present or added during saccharification, fermentation or simultaneous saccharification and fermentation.

n an embodiment, the invention relates to processes for producing fermentation products from starch-containing material comprising the steps of:
i) liquefying the starch-containing material at a temperature above the initial gelatinization temperature using an alpha-amylase;
ii) saccharifying using a carbohydrate-source generating enzyme; and
iii) fermenting using a fermenting organism;
wherein at least one polypeptide having beta-1,6-glucanase activity and/or endo- and/or exo-beta-1,3-glucanase activity are present or added during saccharification, fermentation or simultaneous saccharification and fermentation. In some embodiments, at least two, at least three, at least four, or at least five polypeptides having beta-1,6-glucanase activity and/or endo- and/or exo-beta-1,3-glucanase activity are present and/or added during saccharification, fermentation or simultaneous saccharification and fermentation.

In an embodiment, the invention relates to processes for producing fermentation products from starch-containing material comprising the steps of:
i) liquefying the starch-containing material at a temperature above the initial gelatinization temperature using an alpha-amylase;
ii) saccharifying using a carbohydrate-source generating enzyme; and
iii) fermenting using a fermenting organism;
wherein at least one polypeptide having endo-beta-1,3-glucanase activity and/or exo-beta-1,3-glucanase activity are present or added during saccharification, fermentation or simultaneous saccharification and fermentation. In some embodiments, at least two, at least three, at least four, or at least five polypeptides having endo-beta-1,3-glucanase activity and/or exo-beta-1,3-glucanase activity are present and/or added during saccharification, fermentation or simultaneous saccharification and fermentation.

The at least one polypeptide having beta-1,6-glucanase activity and/or endo- and/or exo-beta-1,3-glucanasee activity present or added in the above described processes for producing fermentation products from starch-containing material may be added exogenously during saccharification, fermentation or simultaneous saccharification and fermentation as mono-components, as enzyme blends or compositions comprising the beta-glucanases, and/or via in-situ expression and secretion of the beta-glucanases by the fermenting organism, e.g., a recombinant host cell or fermenting organism described herein (e.g., yeast, such as from the genus *Saccharomyces*, preferably *Saccharomyces cerevisiae*).

Processes for Producing Fermentation Products from Cellulosic-Containing Material In this aspect, the invention relates to processes for producing fermentation products, especially ethanol, from cellulosic-containing material, which process may include a pretreatment step and sequentially or simultaneously performed saccharification and fermentation steps.

Consequently, the invention relates to processes for producing fermentation products from cellulosic-containing material comprising the steps of:
i) optionally pretreating a cellulosic-containing material;
ii) saccharifying a cellulosic-containing material and/or pretreated cellulosic-containing material using a carbohydrate-source generating enzyme; and iii) fermenting using a fermenting organism;
wherein at least one polypeptide having beta-1,6-glucanase activity and/or at least one polypeptide having endo- and/or exo-beta-1,3-glucanase activity are present or added during saccharifying step ii) or fermentating step iii).

In an embodiment, the invention relates to processes for producing fermentation products from cellulosic-containing material comprising the steps of:
i) optionally pretreating a cellulosic-containing material;
ii) saccharifying a cellulosic-containing material and/or pretreated cellulosic-containing material using a carbohydrate-source generating enzyme; and
iii) fermenting using a fermenting organism;
wherein at least one polypeptide having endo-beta-1,3-glucanase activity and/or at least one polypeptide having exo-beta-1,3-glucanase activity are present or added during saccharifying step ii) or fermentating step iii).

In an embodiment, the invention relates to processes for producing fermentation products from cellulosic-containing material comprising the steps of:
i) optionally pretreating a cellulosic-containing material;
ii) saccharifying a cellulosic-containing material and/or pretreated cellulosic-containing material using a carbohydrate-source generating enzyme; and
iii) fermenting using a fermenting organism;
wherein at least one polypeptide having beta-1,6-glucanase activity and/or endo- and/or exo-beta-1,3-glucanase activity are present or added during saccharifying step ii) or fermentating step iii). In some embodiments, at least two, at least three, at least four, or at least five polypeptides having beta-1,6-glucanase activity and/or endo- and/or exo-beta-1,3-glucanase activity are present and/or added during saccharifying step ii) or fermentating step iii).

In an embodiment, the invention relates to processes for producing fermentation products from cellulosic-containing material comprising the steps of:
i) optionally pretreating a cellulosic-containing material;
ii) saccharifying a cellulosic-containing material and/or the pretreated cellulosic-containing material using a carbohydrate-source generating enzyme; and
iii) fermenting using a fermenting organism;
wherein at least one polypeptide having endo-beta-1,3-glucanase activity and/or exo-beta-1,3-glucanase activity are present or added during saccharifying step ii) or fermentating step iii). In some embodiments, at least two, at least three, at least four, or at least five polypeptides having endo-beta-1,3-glucanase activity and/or exo-beta-1,3-glucanase activity are present and/or added during saccharifying step ii) or fermentating step iii).

The at least one polypeptide having beta-1,6-glucanase activity and/or endo- and/or exo-beta-1,3-glucanasee activity present or added in the above described processes for producing fermentation products from cellulosic-containing material may be added exogenously during saccharification, fermentation or simultaneous saccharification and fermentation as mono-components, as enzyme blends or compositions comprising the beta-glucanases, and/or via in-situ expression and secretion of the beta-glucanases by the fermenting organism, e.g., a recombinant host cell or fermenting organism described herein (e.g., yeast, such as from the genus *Saccharomyces*, preferably *Saccharomyces cerevisiae*).

Steps ii) and iii) are carried out either sequentially or simultaneously. In a preferred embodiment steps ii) and iii) are carried out simultaneously. The alpha-amylase, an optional thermostable protease, may be added before and/or during liquefaction step i).

A composition of the invention may suitably be used in a process of the invention. A recombinant host cell or fermenting organism of the invention may suitably be used in a process of the invention. However, the enzymes may also be added separately.

Whether the process of the invention includes or does not include a liquefaction step or pretreatment step, the essential feature of the invention is that at least one polypeptide having beta-1,6-glucanase activity and/or at least one polypeptide having endo- and/or exo-beta-1,3-glucanase activity are present or added during fermentation or simultaneous saccharification and fermentation. In one embodiment, at least one polypeptide having beta-1,6-glucanase and at least one polypeptide having beta-1,3-glucanase activity are present or added during fermentation or simultaneous saccharification and fermentation. In another embodiment, at least one polypeptide having endo-beta-1,3-glucanase activity and at least one polypeptide having exo-beta-1,3-glucanase activity are present or added during fermentation or simultaneous saccharification and fermentation. As noted above, the at least one polypeptide may be added exogenously as a standalone enzyme or an enzyme blend or composition comprising at least one, at least two, at least three, at least four, or at least five polypeptides having beta-1,6-glucanase activity and/or exo- and/or endo-beta-1,3-glucanase activity, or expressed and secreted in situ by a recombinant host cell or fermenting organism of the present invention comprising at least one, at least two, at least three, at least four, or at least five polypeptides having beta-1,6-glucanase activity and/or exo- and/or endo-beta-1,3-glucanase activity.

Polypeptides Having Beta-Glucanase Activity Used in a Process, Enzyme Blend, or Composition of the Invention Aspects of the present invention relate to polypeptides having beta-glucanase activity, particularly to polypeptides having beta-1,6-glucanase activity and/or polypeptides having beta-1,3-glucanase activity. The present disclosure contemplates processes and enzyme blends or compositions comprising any polypeptides having beta-1,6-glucanase activity and/or polypeptides having beta-1,3-glucanase activity that when used alone, or in combination with each other or other enzymes or compositions described herein (e.g., cellulases/cellulolytic composition) result in an improvement in fermentation product yield (e.g., ethanol yield) compared to similar processes and/or enzyme blends or compositions lacking the polypeptides having beta-1,6-glucanase activity and/or beta-1,3-glucanase activity. Any polypeptide having beta-glucanase activity described herein is also contemplated for expression by a fermenting organism or host cell.

The present inventors have found that beta-glucanases belonging to various GH families are most suitable for application in the present invention, e.g., in one embodiment the polypeptide having beta-1,6-glucanase activity is a member of a glycoside hydrolase (GH) family selected from the group consisting of families GH30, GH5, and GH131, particularly subfamilies GH30_3, GH5_15, GH131. In another embodiment, the polypeptide having beta-1,3-glucanase activity is a member of a GH family selected from the group consisting of families GH16, GH55, GH64 and GH131, particularly subfamily GH55_3.

Exemplary polypeptides having beta-1,6-glucanase activity for use in the processes, compositions, or enzyme blends of the present invention belong to Glycoside Hydrolase (GH) families GH30, GH5, and GH131, preferably from subfamilies GH30_3, GH5_15, GH131A and GH131B, as defined in the database of carbohydrate active enzymes (CAZY—available online). In an embodiment, the at least one polypeptide having beta-1,6-glucanase activity is from a GH family selected from the group consisting of GH30, GH5 and GH131. In an embodiment, the at least one polypeptide having beta-1,6-glucanase activity is from a GH family selected from the group consisting of a GH30_3, GH5_15, and GH131.

Any GH30 family polypeptide having beta-1,6-glucanase activity, in particular GH30_3 subfamily, can be used as a component of an enzyme blend or composition of the invention, or can be present and/or added during saccharification, fermentation, or SSF in a process of the invention. GH30_3 polypeptides having beta-1,6-glucanase activity belong to enzyme class EC 3.2.1.75. Members of EC 3.2.1.75 may be referred to as glucan endo-1,6-beta-glucosidases that catalzye the Random hydrolysis of (1→6)-linkages in (1→6)-β-D-glucans. In addition to acting on 1,6-oligo-beta-D-glucosides, members of this family of enzymes also act on lutean and pustulan. In one aspect, the polypeptide having beta-1,6-glucanase activity is a member of EC 3.2.1.75.

Examples of GH30_3 polypeptides having beta-1,6-glucanase activity which are present and/or added during saccharification, fermentation, or SSF in a process of the invention include, but are not limited to, polypeptides having beta-1,6-glucanase activity that are of: bacterial origin, such as from the genera *Bacteroides*, e.g., *Bacteroides thetaiotaomicron* VPI-5482 (Genbank Accession Nos. AAO78418.1 and NP_812224.1), and *Saccharophagus*, e.g., *Saccharophagus degradans* 2-40 (Genbank Accession No. ABD82251.1); or fungal origin, such as from the genus *Aspergillus*, e.g., *Aspergillus fumigatus* Af293 (Genbank Accession Nos. EAL85472.1 and XP_747510.1), *Lentinula*, e.g., *Lentinula edodes* H600 (Genbank Accession No. BAK52530.1), *Neurospora*, e.g., *Neurospora crassa* IF06068 (Genbank Accession No. BAB91213.1) or *Neurospora crassa* OR74A (Genbank Accession Nos. CAF06053.1 and XP_323748.1), and *Trichoderma*, e.g., *Trichoderma harzianum* (Genbank Accession Nos. CAC80492.1 and ACM42429.1) (the polynucleotide and amino acid sequences of which are incorporated herein by reference to the accession numbers listed above) or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to any of the sequences referenced by accession number thereof, which have beta-1,6-glucanase activity. In some embodiments, at least one GH30_3 polypeptide other than *Bacteroides thetaiotaomicron* VPI-5482 (Genbank Accession Nos. AAO78418.1 and NP_812224.1) *Saccharophagus degradans* 2-40 (Genbank Accession No. ABD82251.1); *Aspergillus fumigatus* Af293 (Genbank Accession Nos. EAL85472.1 and XP_747510.1), *Lentinula edodes* H600 (Genbank Accession No. BAK52530.1), *Neurospora crassa* IF06068 (Genbank Accession No. BAB91213.1), *Neurospora crassa* OR74A (Genbank Accession Nos. CAF06053.1 and XP_323748.1), *Trichoderma harzianum* (Genbank Accession Nos. CAC80492.1 and ACM42429.1), *Bacteroides* thetaiotaomicron VPI-5482 (Genbank Accession Nos. AAO78418.1 and NP_812224.1) and/or *Saccharophagus degradans* 2-40 is present and/or added during saccharification, fermentation, or SSF in a process of the invention.

In some embodiments, a GH30_3 polypeptide having beta-1,6-glucanase activity other than the polypeptide of SEQ ID NO: 32 is present and/or added during saccharification, fermentation, or SSF in a process of the invention, or used as a component of an enzyme blend or composition of the invention. In some embodiments, a GH30_3 polypeptide having beta-1,6-glucanase activity other than the *Trichoderma harzianum* GH30_3 polypeptides disclosed in WO 2018212095 (incorporated herein by reference in its entirety), WO200109295 (incorporated herein by reference in its entirety), WO2014048332 (incorporated herein by reference in its entirety), and WO2014081884 (incorporated herein by reference in its entirety) is present and/or added during saccharification, fermentation, or SSF in a process of the invention, or used as a component of an enzyme blend or composition of the invention.

Preferred examples of GH30_3 polypeptides having beta-1,6-glucanase activity which are present and/or added during saccharification, fermentation, or SSF in a process of the invention, or used as a component of an enzyme blend or composition of the invention include, but are not limited to, polypeptides having beta-1,6-glucanase activity that are of fungal origin, such as from the genus *Trichoderma*, such as *Trichoderma harzianum*, for example, the mature polypeptide of SEQ ID NO: 32, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 32, which have beta-1,6-glucanase activity, or *Trichoderma atroviride*, for example, the mature polypeptide of SEQ ID NO: 119, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 119, or from the genus *Gilmaniella*, such as *Gilmaniella humicola*, for example, the mature polypeptide of SEQ ID NO: 80, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 80, which have beta-1,6-glucanase activity.

Any GH5 family polypeptide having beta-1,6-glucanase activity, in particular GH5_15 subfamily, can be used as a component of an enzyme blend or composition of the invention, or can be present and/or added during saccharification, fermentation, or SSF in a process of the invention. GH5_15 polypeptides having beta-1,6-glucanase activity belong to enzyme class EC 3.2.1.75. Members of EC 3.2.1.75 may be referred to as glucan endo-1,6-beta-glucosidases that catalyze the random hydrolysis of (1→6)-linkages in (1→6)-β-D-glucans. In addition to acting on 1,6-oligo-beta-D-glucosides, members of this family of enzymes also act on lutean and pustulan. In one aspect, the polypeptide having beta-1,6-glucanase activity is a member of EC 3.2.1.75.

Examples of GH5_15 polypeptides having beta-1,6-glucanase activity that are present and/or added during saccharification, fermentation, or SSF in a process of the invention, or used as a component of an enzyme blend or composition of the invention include, but are not limited to, polypeptides having beta-1,6-glucanase activity that are of fungal origin, such as from the genus *Acremonium*, e.g., *Acremonium* IMI 383068 (Uniprot Accession No. P82288) or *Acremonium* sp. OXF C13 (Genbank Accession No. AAT97707.1), *Arthrobotyrs*, e.g., *Arthrobotyrs oligospora* ATCC 24927 (Genbank Accession No. EGX52505.1), *Aspergillus*, e.g., *Aspergillus nidulans* FGSC A4 (Genbank Accession No. EAA59985.1 or ABF50867.1) or *Aspergillus oryzae* RIB40 (Genbank Accession No. BAE65206.1), *Botryis*, e.g., *Botrytis cinera* B05.10 or *Botrytis cinera* T4 (Genbank Accession Nos. ATZ51037.1 and CCD56844.1), *Cordyceps*, e.g., *Cordyceps militaris* ATCC 34164 (ATY62578.1), *Epichloe*, e.g., *Epichloe festucae* FL1 or *Epichloe festucae* var. *lolii* LP19 (Genbank Accession Nos. ABK27195.1 and ABK27199.1), Fusarum, e.g., *Fusarium fujikuroi* IMI 58289 (Genbank Accession Nos. CCT70427.1, CCT74918.1, and CCT71223.1), *Fusarium graminearum* PH-1 (Genbank Accession Nos. SCB64278.1 and CEF76558.1) or, *Fusarium venenatum* A3/5 (Genbank Accession Nos. CE160393.1 and CE167964.1), *Lecancillium*, e.g., *Lecanicillium fungicola* 150-1 (Genbank Accession No. AAO63562.1), *Lolium*, e.g., *Lolium perenne* (Genbank Accession Nos. ARJ57515.1, ARJ57513.1 and ARJ57514.1) *Metarhizium*, e.g., *Metarhizium acridum* CQMa 102 (Genbank Accession No. EFY84753.1), *Neotyphodium*, e.g., *Neotyphodium* sp. FCB-2002 (AAN04103.1), *Pyricularia*, e.g., *Pyricularia oryzae* (Genbank Accession No. QBZ58410.1), Sclerotina, e.g., *Sclerotinia sclerotiorum* 1980 UF-70 (Genbank Accession No. APA15786.1), *Trichoderma*, e.g., *Trichoderma harzianum* (Genbank Accession Nos. CAA55789.1, ACM42428.1 and CAA55788.1), *Trichoderma* harzianum 12 (Genbank Accession No. ACE81431.1), or *Trichoderma virens* (Genbank Accession Nos. AAL84696.1 and ABV71387.1), *Ventura*, e.g., *Ventura effusa albino* (Genbank Accession No. QDS69220.1), and *Verticillium*, e.g., *Verticillium* dahlia (Genbank Accession No. AGW80454.1) or *Verticillium* dahlia 76 (Genbank Accession No. AAX73406.1) (the polynucleotide and amino acid sequences of which are incorporated herein by reference to the accession numbers listed above) or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to any of the sequences referenced by accession number thereof, which have beta-1,6-glucanase activity.

In some embodiments, at least one GH5_15 polypeptide other than *Acremonium* IMI 383068 (Uniprot Accession No. P82288), *Acremonium* sp. OXF C13 (Genbank Accession No. AAT97707.1), *Arthrobotyrs oligospora* ATCC 24927 (Genbank Accession No. EGX52505.1), *Aspergillus nidulans* FGSC A4 (Genbank Accession No. EAA59985.1 or ABF50867.1), *Aspergillus oryzae* RIB40 (Genbank Accession No. BAE65206.1), *Botrytis cinera* B05.10, *Botrytis cinera* T4 (Genbank Accession Nos. ATZ51037.1 and CCD56844.1), *Cordyceps militais* ATCC 34164 (ATY62578.1), *Epichloe festucae* FL1 or *Epichloe festucae* var. *lolii* LP19 (Genbank Accession Nos. ABK27195.1 and ABK27199.1), *Fusarium fujikuroi* IMI 58289 (Genbank Accession Nos. CCT70427.1, CCT74918.1, and CCT71223.1), *Fusarium graminearum* PH-1 (Genbank Accession Nos. SCB64278.1 and CEF76558.1), *Fusarium venenatum* A3/5 (Genbank Accession Nos. CE160393.1 and CE167964.1), *Lecanicillium fungicola* 150-1 (Genbank Accession No. AAO63562.1), *Lolium perenne* (Genbank Accession Nos. ARJ57515.1, ARJ57513.1 and ARJ57514.1) *Metarhizium acridum* CQMa 102 (Genbank Accession No. EFY84753.1), *Neotyphodium*, e.g., *Neotyphodium* sp. FCB-2002 (AAN04103.1), *Pyricularia oryzae* (Genbank Accession No. QBZ58410.1), *Sclerotinia sclerotiorum* 1980 UF-70 (Genbank Accession No. APA15786.1), *Trichoderma harzianum* (Genbank Accession Nos. CAA55789.1, ACM42428.1 and CAA55788.1), *Trichoderma* harzianum 12 (Genbank Accession No. ACE81431.1), *Trichoderma virens* (Genbank Accession Nos. AAL84696.1 and ABV71387.1), *Ventura*, e.g., *Ventura effusa albino* (Genbank Accession No. QDS69220.1), *Verticillium dahlia* (Genbank Accession No. AGW80454.1), and/or *Verticillium dahlia* 76 (Genbank Accession No. AAX73406.1) is present and/or added during saccharification, fermentation, or SSF in a process of the invention, or used as a component of an enzyme blend or composition of the invention.

In some embodiments, a GH5_15 polypeptide having beta-1,6-glucanase activity other than the polypeptide of SEQ ID NO: 2 is present and/or added during saccharification, fermentation, or SSF in a process of the invention, or used as a component of an enzyme blend or composition of the invention. In some embodiments, a GH5_15 polypeptide having beta-1,6-glucanase activity other than the *Trichoderma harzianum* GH5_15 polypeptides disclosed in WO9531435 (incorporated herein by reference in its entirety) is present and/or added during saccharification, fermentation, or SSF in a process of the invention, or used as a component of an enzyme blend or composition of the invention. In some embodiments, a GH5_15 polypeptide having beta-1,6-glucanase activity other than the polypeptide of SEQ ID NO: 92 is present and/or added during saccharification, fermentation, or SSF in a process of the invention, or used as a component of an enzyme blend or composition of the invention. In some embodiments, a GH5_15 polypeptide having beta-1,6-glucanase activity other than the *Rasamsonia byssochlamydoides* GH5_15 polypeptides disclosed in WO2014/138983 (incorporated herein by reference in its entirety) is present and/or added during saccharification, fermentation, or SSF in a process of the invention, or used as a component of an enzyme blend or composition of the invention.

Preferred examples of GH5_15 polypeptides having beta-1,6-glucanase activity which can be present and/or added during saccharification, fermentation, or SSF in a process of the invention, or used as a component of an enzyme blend or composition of the invention include, without limitation, polypeptides having beta-1,6-glucanase activity that are of fungal origin, such as from the genus *Trichoderma*, such as *Trichoderma harzianum*, for example, the mature polypeptide of SEQ ID NO: 2, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 2 or SEQ ID NO: 3, which have beta-1,6-glucanase activity, or *Trichoderma atroviride*, for example, the mature polypeptide of SEQ ID NO: 38 or SEQ ID NO: 41, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 38 or SEQ ID NO: 41, or *Trichoderma longipile*, for example, the mature polypeptide of SEQ ID NO: 95, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 95, or *Trichoderma koningiopsis*, for example the mature polypeptide of SEQ ID NO: 98, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 98, or *Trichoderma koningii*, for example the mature polypeptide of SEQ ID NO: 101, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 101, or *Trichoderma sinuosum*, for example the mature polypeptide of SEQ ID NO: 104, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 104, or from the genus *Simplicillium*, such as *Simplicillium lamellicola*, for example, the mature polypeptide of SEQ ID NO: 35, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 35, which have beta-1,6-glucanase activity, or from the genus *Fusarium*, such as *Fusarium solani*, for example, the mature polypeptide of SEQ ID NO: 77, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 77, which have beta-1,6-glucanase activity.

Exemplary polypeptides having beta-1,3-glucanase activity belong to Glycoside Hydrolase (GH) families GH16, GH55, GH64 and GH131, as defined in the database of carbohydrate active enzymes (CAZY—available online). In an embodiment, the at least one polypeptide having beta-1,3-glucanase activity is from a GH family selected from the group consisting of GH16, GH55, GH64 and GH131. In an embodiment, the at least one polypeptide having beta-1,3-glucanase activity is from a GH family selected from the group consisting of a GH16, GH55_3, GH64, and GH131.

Any GH16 family polypeptide having beta-1,3-glucanase activity can be used as a component of an enzyme blend or composition of the invention, or can be present and/or added during saccharification, fermentation, or SSF in a process of the invention. GH16 polypeptides having beta-1,3-glucanase activity may possess exo- and/or endo-1,3-beta-glucanase activity and belong to enzyme class EC 3.2.1.39 or endo-1,3(4)-beta-glucanase activity and belong to enzyme class EC 3.2.1.6. Members of EC 3.2.1.39 may be referred to as glucan endo-1,3-beta-D-glucosidases that catalzye the hydrolysis of (1→3)-β-D-glucosidic linkages in (1-3)-β-D-glucans. In addition to having some activity on mixed-link (1→3,1→4)-β-D-glucans, members of this family of enzymes also act on laminarin, paramylon and pachyman. In one aspect, the polypeptide having beta-1,3-glucanase activity is a member of EC 3.2.1.39. Members of EC 3.2.1.6 may be referred to as endo-1,3(4)-beta-glucanases that catalzye the endohydrolysis of (1→3)- or (1→4)-linkages in β-D-glucans when the glucose residue whose reducing group is involved in the linkage to be hydrolysed is itself substituted at C-3. Members of this class may act laminarin, lichenin and cereal D-glucans. In one aspect, the polypeptide having beta-1,3-glucanase activity is a member of EC 3.2.1.6.

Examples of GH16 polypeptides having beta-1,3-glucanase activity which can be present and/or added during saccharification, fermentation, or SSF in a process of the invention, or used as a component of an enzyme blend or composition of the invention include, but are not limited to, polypeptides having beta-1,3-glucanase activity that are: of archaeal origin, such as from the genus *Pyrococcus*. e.g., *Pyrococcus fuiosus* DSM 3638 (Genbank Accession Nos. AAC25554.2, AAL80200.1 and NP_577805.1); of bacterial origin, such as from the genus *Bacillus*, e.g., *Bacillus circulans* IAM1165 (Genbank Accession Nos. BAC06195.1, AAC60453.1 and BAA04469.1), *Bacillus circulans* WL-12 Genbank Accession No. AAA22474.1), *Bacillus licheniformis* (Genbank Accession Nos. AAQ67340.1, AAN64132.1, and AAO18342.1), *Bacteroides*, e.g., *Bacteroides ovatus* ATCC 8483 (Genbank Accession Nos. ALJ47757.1 and EDO11532.1), *Caldicellulosiruptor*, e.g., *Caldicellulosiruptor kronotskyensis* 2002 (Genbank Accession No. ADQ45027.1), *Cellulosimicrobium*, e.g., *Cellulosimicrobium cellulans* LL-G109/DSM10297/DK-1 (Genbank Accession Nos. AAC38290.1, AAB39377.1, AAB39378.1, AAB47151.1, AAB47152.1, AAB47153.1, AEK80404.1, and EU589324) and *Cellulosimicrobium cellulans* LL-G109 DSM10297 (Genbank Accession No. AAC44371.1), *Flavobacterium*, e.g., *Flavobacterium johnsoniae* UW101 (Genbank Accession Nos. ABQ071852 and ABQ07185.1) and *Flavobacterium* sp. 4221 (Genbank Accession No. ABWD2990.1), *Formosa*, e.g., *Formosa algae* KMM 3553 (Genbank Accession No. AJF35005.1), *Hungateiclostridium*, e.g., *Hungateiclostridium thermocellum* DSM 1237 (Genbank Accession No. CAA61884.2) and *Hungateiclostridium thermocellum* F7 (Genbank Accession No. CAC27412.2), *Laceyella*, e.g., *Laceyella putida* JAM-FM3001 (Genbank Accession No. BAR92731.1), *Lysobacter*, e.g., *Lysobacter enzymogenes* N4-7 (Genbank Accession Nos. AAN77503.1 and AAN77505.1), and *Nocardiopsis*, e.g., *Nocardiopsis* sp. F96 (Genbank Accession No. BAE54302.1), *Paenibacillus*, e.g., *Paenibacillus* sp. CCRC 17245 (Genbank Accession No. ABJ15796.1), *Paenibacillus* sp. f-40 (Genbank Accession No. ABD94065.1), or *Paenibacillus* sp. S09 (AF067889.1), *Pedobacter*, e.g., *Pedobacter* sp. 4236 (Genbank Accession No. ABWO2992.1), *Pseudomonas* sp. PE2 (Genbank Accession No. BAC16331.1), *Rhodothermus*, e.g., *Rhodothermus marinus* ITI278 (Genbank Accession No. AAC69707.1), *Ruminococcus*, e.g., *Ruminococcus albus* 8 (Genbank Accession No. EGC02853.1), *Sinorhizobium*, e.g., *Sinorhizobium meliloti* 1021 (Genbank Accession Nos. AAA16048.1, CAC49480.1, NP_437620.1), *Streptomyces*, e.g., *Streptomyces sioyaensis* (Genbank Accession No. AAF31438.1) and *Streptomyces* sp. S27 (Genbank Accession No. AC094508.1), *Thermotoga*, e.g., *Thermotoga maritima* MSB8 (Genbank Accession Nos. AAD35118.1, AGL48947.1, AHD18205.1, AKE27833.1, and NP_227840.1) and *Thermotoga petrophila* RKU-1 (Genbank Accession No. ABQ46917.1), *Zobellia*, e.g., *Zobellia galactanivorans* DsijT (Genbank Accession Nos. CAZ95067.1 and CAZ96583.1); or of fungal origin, such as from the genus *Aspergillus*, e.g., *Aspergillus fumigatus* Af293 (Genbank Accession Nos. EAL93731.1, ACQ08899.1, and XP_755769.1), *Bipolaris*, e.g., *Bipolaris zeicola* 367-2A (Genbank Accession No. AAC49904.1), *Humicola*, e.g., *Humicola insolens* Y1 (Genbank Accession No. ALM88585.1), *Paecilomyces*, e.g., *Paecilomyces* sp. FLH30 (Genbank Accession No. ADZ46179.1), *Phanerochaete*, (Genbank Accession No. BAC67687.1) (the polynucleotide and amino acid sequences of which are incorporated herein by reference to the accession numbers listed above) or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to any of the sequences referenced by accession number thereof, which have beta-1,3-glucanase activity.

In some embodiments, at least one GH16 polypeptide other than *Pyrococcus furiosus* DSM 3638 (Genbank Accession Nos. AAC25554.2, AAL80200.1 and NP_577805.1); *Bacillus circulans* IAM1165 (Genbank Accession Nos. BAC06195.1, AAC60453.1 and BAA04469.1), *Bacillus circulans* WL-12 Genbank Accession No. AAA22474.1), *Bacillus licheniformis* (Genbank Accession Nos. AAQ67340.1, AAN64132.1, and AAO18342.1), *Bacteroides ovatus* ATCC 8483 (Genbank Accession Nos. ALJ47757.1 and EDO11532.1), *Caldicellulosiruptor kronotskyensis* 2002 (Genbank Accession No. ADQ45027.1), *Cellulosimicrobium cellulans* LL-G109/DSM10297/DK-1 (Genbank Accession Nos. AAC38290.1, AAB39377.1, AAB39378.1, AAB47151.1, AAB47152.1, AAB47153.1, AEK80404.1, and EU589324), *Cellulosimicrobium cellulans* LL-G109 DSM10297 (Genbank Accession No. AAC44371.1), *Flavobacterium johnsoniae* UW101 (Genbank Accession Nos. ABQ071852 and ABQ07185.1), *Flavobacterium* sp. 4221 (Genbank Accession No. ABWD2990.1), *Formosa algae* KMM 3553 (Genbank Accession No. AJF35005.1), *Hungateiclostridium thermocellum* DSM 1237 (Genbank Accession No. CAA61884.2), *Hungateiclostridium thermocellum* F7 (Genbank Accession No. CAC27412.2), *Laceyella putida* JAM-FM3001 (Genbank Accession No. BAR92731.1), *Lysobacter enzymogenes* N4-7 (Genbank Accession Nos. AAN77503.1 and AAN77505.1), *Nocardiopsis* sp. F96 (Genbank Accession No. BAE54302.1), *Paenibacillus* sp. CCRC 17245 (Genbank Accession No. ABJ15796.1), *Paenibacillus* sp. f-40 (Genbank Accession No. ABD94065.1), *Paenibacillus* sp. S09 (AF067889.1), *Pedobacter* sp. 4236 (Genbank Accession No. ABWD2992.1), *Pseudomonas* sp. PE2 (Genbank Accession No. BAC16331.1), *Rhodothermus marinus* ITI278 (Genbank Accession No. AAC69707.1), *Ruminococcus albus* 8 (Genbank Accession No. EGC02853.1), *Sinorhizobium meliloti* 1021 (Genbank Accession Nos. AAA16048.1, CAC49480.1, NP_437620.1), *Streptomyces sioyaensis* (Genbank Accession No. AAF31438.1) and *Streptomyces* sp. S27 (Genbank Accession No. AC094508.1), *Thermotoga maritima* MSB8 (Genbank Accession Nos. AAD35118.1, AGL48947.1, AHD18205.1, AKE27833.1, NP_227840.1), *Thermotoga petrophila* RKU-1 (Genbank Accession No. ABQ46917.1), *Zobellia galactanivorans* DsijT (Genbank Accession Nos. CAZ95067.1 and CAZ96583.1); *Aspergillus fumigatus* Af293 (Genbank Accession Nos. EAL93731.1, ACQ08899.1, and XP_755769.1), *Biopolaris zeicola* 367-2A (Genbank Accession No. AAC49904.1), *Humicola insolens* Y1 (Genbank Accession No. ALM88585.1), *Paecilomyces* sp. FLH30 (Genbank Accession No. ADZ46179.1), and/or (Genbank Accession No. BAC67687.1) is present and/or added during saccharification, fermentation, or SSF in a process of the invention, or used as a component of an enzyme blend or composition of the invention.

Preferred examples of GH16 polypeptides having beta-1,3-glucanase activity which can be present and/or added during saccharification, fermentation, or SSF in a process of the invention, or used as a component of an enzyme blend or composition of the invention include, but are not limited to, polypeptides having beta-1,3-glucanase activity that are of fungal origin, such as from the genera: *Simplicillium*, such as *Simplicillium lamellicola*, for example the mature polypeptide of SEQ ID NO: 20, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 20, which have beta-1,3-glucanase activity; *Trichoderma*, such as *Trichoderma reesei*, *Trichoderma atroviride*, or *Trichoderma harzianum*, for example the mature polypeptides of SEQ ID NO: 23, SEQ ID NO: 26 or SEQ ID NO: 147 respectively, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 23, SEQ ID NO: 26, or SEQ ID NO: 147, which have beta-1,3-glucanase activity; or *Aspergillus*, such as *Aspergillus nidulans*, for example, the mature polypeptide of SEQ ID NO: 29, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 29, which have beta-1,3-glucanase activity, or such as *Aspergillus nidulans* FGSC A4, for example, the mature polypeptide of SEQ ID NO: 144, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, but less than 100% identity, to the mature polypeptide of SEQ ID NO: 144, which have beta-1,3-glucanase activity, or from the genus *Albifimbria*, such as *Albifimbria verrucara*, for example, the mature polypeptide of SEQ ID NO: 86, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 86, which have beta-1,3-glucanase activity, or from the genus *Lacanicillium*, such as *Lacanicillium* sp. WMM742, for example the mature polypeptide of SEQ ID NO: 89, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 89, which have beta-1,3-glucanase activity.

In some embodiments, a GH16 polypeptide having exo- and/or -endo beta-1,3-glucanase activity other than the *Aspergillus nidulans* FSC A4 polypeptide disclosed in WO2013/177714 (which is incorporated herein by reference in its entirety) is present and/or added during saccharification, fermentation, or SSF in a process of the invention, or is used as a component of an enzyme blend or composition of the invention. In an embodiment, the GH16 polypeptides having beta-1,3-glucanase activity which can be present and/or added during saccharification, fermentation, or SSF in a process of the invention, or used as a component of an enzyme blend or composition of the invention does not include the beta-1,3-glucanase of SEQ ID NO: 144. In an embodiment, the GH16 polypeptides having beta-1,3-glucanase activity which can be present and/or added during saccharification, fermentation, or SSF in a process of the invention, or used as a component of an enzyme blend or composition of the invention include polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, but less than 100% identity, to the mature polypeptide of SEQ ID NO: 144, which have beta-1,3-glucanase activity.

In some embodiments, a GH16 polypeptide having exo- and/or -endo beta-1,3-glucanase activity other than the *Trichoderam harzianum* polypeptide disclosed in WO95/31533 (which is incorporated herein by reference in its entirety) is present and/or added during saccharification, fermentation, or SSF in a process of the invention, or is used as a component of an enzyme blend or composition of the invention. In an embodiment, the GH16 polypeptides having beta-1,3-glucanase activity which can be present and/or added during saccharification, fermentation, or SSF in a process of the invention, or used as a component of an enzyme blend or composition of the invention does not include the beta-1,3-glucanase of SEQ ID NO: 147. In an embodiment, the GH16 polypeptides having beta-1,3-glucanase activity which can be present and/or added during saccharification, fermentation, or SSF in a process of the invention, or used as a component of an enzyme blend or composition of the invention include polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, at least 99.4% identity, at least 99.5% identity, at least 99.6% identity, at least 99.7% identity, at least 99.8% identity, at least 99.9% identity, but less than 100% identity, to the mature polypeptide of SEQ ID NO: 147, which have beta-1,3-glucanase activity. Any GH55 family polypeptide having beta-1,3-glucanase activity, in particular GH55_3 subfamily, can be used as a component of an enzyme blend or composition of the invention, or can be present and/or added during saccharification, fermentation, or SSF in a process of the invention. GH55_3 polypeptides having beta-1,3-glucanase activity may possess endo-beta-1,3-glucanase activity and belong to enzyme class EC 3.2.1.39 or exo-beta-1,3-glucanase activity and belong to enzyme class EC 3.2.1.58. Members of EC 3.2.1.39 may be referred to as glucan endo-1,3-beta-D-glucosidases that catalzye the hydrolysis of (1→3)-β-D-glucosidic linkages in (1→3)-β-D-glucans. In addition to having some activity on mixed-link (1→3,1→4)-β-D-glucans, members of this family of enzymes also act on laminarin, paramylon and pachyman. In one aspect, the polypeptide having beta-1,3-glucanase activity is a member of EC 3.2.1.39. Members of EC 3.2.1.58 may be referred to as glucan 1,3-beta-glucosidases that catalzye the successive hydrolysis of beta-D-glucose units from the non-reducing ends of (1→3)-β-D-glucans, releasing alpha-glucose. Members of this class act on oligosaccharides, and on laminaribiose. In one aspect, the polypeptide having beta-1,3-glucanase activity is a member of EC 3.2.1.58.

Examples of GH55 polypeptides having beta-1,3-glucanase activity which can be present and/or added during saccharification, fermentation, or SSF in a process of the invention, or can be used as a component of an enzyme blend or composition of the invention include, but are not limited to, polypeptides having beta-1,3-glucanase activity that are: of bacterial origin, such as from the genera: *Arthrobacter*, e.g., *Arthrobacter* sp. NHB-10 (Genbank Accession No. BAF52916.1), Caldicellulosiruptor, e.g., *Caldicellulosiruptor kronotskyensis* 2002 (Genbank Accession No. ADQ45027.1), *Streptomyces*, e.g., *Streptomyces* sp. SirexAA-E (Genbank Accession No. AEN12197.1); or of fungal origin, such as from the genera: *Acremonium*, e.g., *Acremonium persicinum* QM107a (Genbank Accession Nos. S56003 and S56004), *Acremonium* sp. OXF_C13 (Genbank Accession No. AAW47927.1), *Ampelomyces*, e.g., *Ampelomyces quisqualis* (Genbank Accession Nos. AAC09172.1 and AAV00002.1), *Aspergillus*, e.g., *Aspergillus phoenicis* ATCC14332 (Genbank Accession No. BAB83607.1), *Bipolaris*, e.g., *Bipolaris* zeicola SB111 (Genbank Accession Nos. AAC71062.1 and AAV00001.1), *Chaetomium*, e.g., *Chaetomium thermophilum* CT2 (Genbank Accession Nos. ACS66685.1 and AC114529.1), *Coniothyrium*, e.g., *Coniothyrium minitans* (Genbank Accession No. AAU99998.1) or *Coniothyrium minitans* CM2 (Genbank Accession No. AAF63758.1), *Lentinula edodes* H600 (Genbank Accession Nos. BAE20245.1 and BAE44303.1), *Penicillium*, e.g., *Penicillium* sp. KH10 (Genbank Accession No. BAH69264.1), *Phanerochaete*, e.g., *Phanerochaete chrysosporium* K-3 (Genbank Accession No. BAE48426.1), *Trichoderma*, e.g., *Trichoderma* asperellum (Genbank Accession No. ABY19519.1), *Trichoderma atroviride* P1 (Genbank Accession No. AAF80600.1), *Trichoderma hamatum* LU593 (Genbank Accession No. AAP33112.1), *Trichoderma harzianum* CECT 2413/12 (Genbank Accession Nos. AAV00004.1, ACE81432.1, and CAA58889.1), *Trichoderma harzianum* T-Y (Genbank Accession Nos. AAV00003.1 and CAA5375.1), *Trichoderma* Wrens (Genbank Accession No. AAL84695.1), *Trichoderma viride* LTR-2 (Genbank Accession Nos. ABM55269.1, ABD07373.1, and AIC32930.1), and *Trichoderma viride* U-1 (Genbank Accession No. BAD67019.1) (the polynucleotide and amino acid sequences of which are incorporated herein by reference to the accession numbers listed above) or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to any of the sequences referenced by accession number thereof, which have beta-1,3-glucanase activity.

In some embodiments, at least one GH 55_3 polypeptide other than *Arthrobacter* sp. NHB-10 (Genbank Accession No. BAF52916.1), *Caldicellulosiruptor kronotskyensis* 2002 (Genbank Accession No. ADQ45027.1), *Streptomyces* sp. SirexAA-E (Genbank Accession No. AEN12197.1); *Acremonium persicinum* QM107a (Genbank Accession Nos. S56003 and S56004), *Acremonium* sp. OXF_C13 (Genbank Accession No. AAW47927.1), *Ampelomyces quisqualis* (Genbank Accession Nos. AAC09172.1 and AAV00002.1), *Aspergillus phoenicis* ATCC14332 (Genbank Accession No. BAB83607.1), *Bipolaris* zeicola SB111 (Genbank Accession Nos. AAC71062.1 and AAV00001.1), *Chaetomium thermophilum* CT2 (Genbank Accession Nos. ACS66685.1 and AC114529.1), *Coniothyrium minitans* (Genbank Accession No. AAU99998.1), *Coniothyrium minitans* CM2 (Genbank Accession No. AAF63758.1), *Lentinula edodes* H600 (Genbank Accession Nos. BAE20245.1 and BAE44303.1), *Penicillium* sp. KH10 (Genbank Accession No. BAH69264.1), *Phanerochaete chrysosporium* K-3 (Genbank Accession No. BAE48426.1), *Trichoderma asperellum* (Genbank Accession No. ABY19519.1), *Trichoderma atroviride* P1 (Genbank Accession No. AAF80600.1), *Trichoderma hamatum* LU593 (Genbank Accession No. AAP33112.1), *Trichoderma harzianum* CECT 2413/12 (Genbank Accession Nos. AAV00004.1, ACE81432.1, and CAA58889.1), *Trichoderma harzianum* T-Y (Genbank Accession Nos. AAV00003.1 and CAA5375.1), *Trichoderma virens* (Genbank Accession No. AAL84695.1), *Trichoderma viride* LTR-2 (Genbank Accession Nos. ABM55269.1, ABD07373.1, and AIC32930.1), and/or *Trichoderma viride* U-1 (Genbank Accession No. BAD67019.1) is present and/or added during saccharification, fermentation, or SSF in a process of the invention, or can be used as a component of an enzyme blend or composition of the invention.

In some embodiments, a GH55_3 polypeptide having exo- and/or -endo beta-1,3-glucanase activity other than the polypeptide of SEQ ID NO: 5 is present and/or added during saccharification, fermentation, or SSF in a process of the invention, or used as a component of an enzyme blend or composition of the invention. In some embodiments, a GH55_3 polypeptide having exo- and/or -endo beta-1,3-glucanase activity other than the *Trichoderma harzianum* GH55_3 polypeptides disclosed in WO2015048332 and WO2014081884 (both of which are incorporated herein by reference in their entirety) is present and/or added during saccharification, fermentation, or SSF in a process of the invention, or is used as a component of an enzyme blend or composition of the invention.

Preferred examples of GH55_3 polypeptides having beta-1,3-glucanase activity which can be present and/or added during saccharification, fermentation, or SSF in a process of the invention, or can be used as a component of an enzyme blend or composition of the invention include, but are not limited to, polypeptides having beta-1,3-glucanase activity that are of fungal origin, such as from the genus *Trichoderma*, such as *Trichoderma harzianum*, for example the mature polypeptide of SEQ ID NO: 5 or SEQ ID NO: 107, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 5 or SEQ ID NO: 107, which have beta-1,3-glucanase activity, or *Trichoderma atroviride*, for example, the mature polypeptide of SEQ ID NO: 110 or SEQ ID NO: 116, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID nO: 110 or SEQ ID NO: 116, or from the genus *Simplicillium*, such as *Simplicillium lamellicola*, for example, the mature polypeptide of SEQ ID NO: 113, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 113, or from the genus *Hamigera*, such as *Hamigera inflata*, for example, the mature polypeptide of SEQ ID NO: 150, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 150.

Any GH64 family polypeptide having beta-1,3-glucanase activity can be used as a component of an enzyme blend or composition of the invention, or can be present and/or added during saccharification, fermentation, or SSF in a process of the invention. GH64 polypeptides having beta-1,3-glucanase activity may possess endo-beta-1,3-glucanase activity and/or endo-beta-1,3-glucanase activity and belong to enzyme class EC 3.2.1.39. Members of EC 3.2.1.39 may be referred to as glucan endo-1,3-beta-D-glucosidases that catalzye the hydrolysis of (1→3)-β-D-glucosidic linkages in (1→3)-β-D-glucans. In addition to having some activity on mixed-link (1→3,1→4)-β-D-glucans, members of this family of enzymes also act on laminarin, paramylon and pachyman. In one aspect, the polypeptide having beta-1,3-glucanase activity is a member of EC 3.2.1.39.

Examples of GH64 polypeptides having beta-1,3-glucanase activity which can be present and/or added during saccharification, fermentation, or SSF in a process of the invention, or can be used as a component of an enzyme blend or composition of the invention include, but are not limited to, polypeptides having beta-1,3-glucanase activity that are of bacterial origin, such as from the genera: *Arthrobacter*, e.g., *Arthrobacter* sp. YCWD3 (Genbank Accession No. BAA04892.1), *Cellulosimicrobium*, e.g., *Cellulosimicrobium cellulans* 73_14 (Genbank Accession No. AAA25520.1), *Kribbella*, e.g., *Kribbella flavida* DSM 17836 (Genbank Accession No. ADB34580.1), *Lysobacter*, e.g., *Lysobacter enzymogenes* N4-7 (Genbank Accession No. AAN77504.1), and *Streptomyces*, e.g., *Streptomyces matensis* D/C-108 (Genbank Accession No. BAA34349.1) (the polynucleotide and amino acid sequences of which are incorporated herein by reference to the accession numbers listed above) or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to any of the sequences referenced by accession number thereof, which have beta-1,3-glucanase activity.

In some embodiments, at least one GH64 polypeptide other than *Arthrobacter* sp. YCWD3 (Genbank Accession No. BAA04892.1), *Cellulosimicrobium cellulans* 73_14 (Genbank Accession No. AAA25520.1), *Kribbella flavida* DSM 17836 (Genbank Accession No. ADB34580.1), *Lysobacter enzymogenes* N4-7 (Genbank Accession No. AAN77504.1), and/or *Streptomyces matensis* D/C-108 (Genbank Accession No. BAA34349.1) is present and/or added during saccharification, fermentation, or SSF in a process of the invention.

Preferred examples of GH64 polypeptides having beta-1,3-glucanase activity which can be present and/or added during saccharification, fermentation, or SSF in a process of the invention, or can be used as a component of an enzyme blend or composition of the invention include, but are not limited to, polypeptides having beta-1,3-glucanase activity that are of fungal origin, such as from the genera: *Trichoderma*, such as *Trichoderma harzianum*, for example the mature polypeptide of SEQ ID NO: 8 or SEQ ID NO: 11 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 8 or SEQ ID NO: 11, which have beta-1,3-glucanase activity; *Lecanicillium*, such as *Lecanicillium primulinum*, for example the mature polypeptide of SEQ ID NO: 14 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 14, which have beta-1,3-glucanase activity; and *Simplicillium*, such as *Simplicillium lamellicola*, for example the mature polypeptide of SEQ ID NO: 17 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 17, which have beta-1,3-glucanase activity, or from the genus *Gliomastix*, such as *Gliomastix murorum*, for example the mature polypeptide of SEQ ID NO: 83 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 83, which have beta-1,3-glucanase activity, or from the genus *Acremonium*, such as *Acremonium exiguum*, for example the mature polypeptide of SEQ ID NO: 153, or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 153, which have beta-1,3-glucanase activity.

Any GH131 family polypeptide having beta-1,3-glucanase activity and/or beta-1,6-glucanase activity can be used as a component of an enzyme blend or composition of the invention, or can be present and/or added during saccharification, fermentation, or SSF in a process of the invention. GH131 polypeptides having beta-1,3-glucanase activity may possess endo-beta-1,3-glucanase activity and/or endo-beta-1,3-glucanase activity and/or beta-1,6-glucanase activity.

Examples of GH131 polypeptides having beta-1,3-glucanase activity and/or beta-1,6-glucanase activity which can be present and/or added during saccharification, fermentation, or SSF in a process of the invention include, but are not limited to, polypeptides having beta-1,3-glucanase activity and/or beta-1,6-glucanase activity that are of fungal origin, such as from the genus *Podospora*, e.g., *Podospora anserine* S mat+(Genbank Accession Nos. AFQ89876.1, CAP61309.1 and CBX32765.1) (the polynucleotide and amino acid sequences of which are incorporated herein by reference to the accession numbers listed above) or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to any of the sequences referenced by accession number thereof, which have beta-1,3-glucanase activity and/or beta-1,6-glucanase activity.

Preferred examples of GH131 polypeptides having beta-1,3-glucanase activity and/or beta-1,6-glucanase activity which can be present and/or added during saccharification, fermentation, or SSF in a process of the invention, or used as a component of the enzyme blends, and compositions of the invention include, but are not limited to, polypeptides having beta-1,3-glucanase activity and/or beta-1,6-glucanase activity that are of fungal origin, such as from the genera: *Comyascus*, such as *Comyascus sepedonium*, for example the mature polypeptide of SEQ ID NO: 44 or SEQ ID NO: 74 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 44 or SEQ ID NO: 74, which have beta-1,3-glucanase activity and/or beta-1,6-glucanase activity; *Aspergillus*, such as *Aspergillus wentii*, for example, the mature polypeptide of SEQ ID NO: 47 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 47, which have beta-1,3-glucanase activity and/or beta-1,6-glucanase activity; *Acrophialophora*, such as *Acrophialophora fusispora*, for example the mature polypeptide of SEQ ID NO: 50 or SEQ ID NO: 53 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 50 or SEQ ID NO: 53, which have beta-1,3-glucanase activity and/or beta-1,6-glucanase activity; *Rhinocladiella*, such as *Rhinocladiella* sp., for example the mature polypeptide of SEQ ID NO: 56 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 56, which have beta-1,3-glucanase activity and/or beta-1,6-glucanase activity; *Nemania*, such as *Nemania serpens*, for example the mature polypeptide of SEQ ID NO: 59 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 59, which have beta-1,3-glucanase activity and/or beta-1,6-glucanase activity; *Talaromyces*, such as *Talaromyces leycettanus*, for example the mature polypeptide of SEQ ID NO: 62 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 62, which have beta-1,3-glucanase activity and/or beta-1,6-glucanase activity; *Collariella*, such as *Collariella virescens*, for example the mature polypeptide of SEQ ID NO: 65 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 65, which have beta-1,3-glucanase activity and/or beta-1,6-glucanase activity; *Rigidoporus*, such as *Rigidoporus* sp. 74222, for example the mature polypeptide of SEQ ID NO: 68 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 68, which have beta-1,3-glucanase activity and/or beta-1,6-glucanase activity; and *Loramyces*, such as *Loramyces macrosporus*, for example the mature polypeptide of SEQ ID NO: 71 or polypeptides having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity to the mature polypeptide of SEQ ID NO: 71, which have beta-1,3-glucanase activity and/or beta-1,6-glucanase activity.

In some embodiments, a GH131 polypeptide having beta-1,6-glucanase and/or exo- and/or -endo beta-1,3-glucanase activity other than the polypeptide of SEQ ID NO: 44 is present and/or added during saccharification, fermentation, or SSF in a process of the invention, or is used as a component of an enzyme blend or composition of the invention. In some embodiments, a GH131 polypeptide having beta-1,6-glucanase and/or exo- and/or -endo beta-1,3-glucanase activity other than the polypeptides disclosed in WO2015109405 (which is incorporated herein by reference in their entirety) is present and/or added during saccharification, fermentation, or SSF in a process of the invention, or is as a component of an enzyme blend or composition of the invention.

In a preferred embodiment the at least one polypeptide having beta-1,6-glucanase activity and the at least one polypeptide having beta-1,3-glucanase activity present and/or added during saccharification, fermentation, or SSF in a process of the invention, or used as a component of an enzyme blend or composition of the invention is selected from the combinations:

i) GH5_15 and GH64;
ii) GH5_15 and GH30_3 and GH16;
iii) GH5_15 and GH64 and GH16;
iv) GH5_15 and GH55_3;
v) GH55_3 and GH64;
vi) GH5_15 and GH55_3 and GH64;
vii) GH5_15 and GH131
viii) GH16 and GH64;
ix) G5_15 and GH30_3;
x) GH16 and GH55_3; and
xi) GH131 and GH131.

In a further specific embodiment, and particularly according to the combinations i) to xi) above, the beta-glucanases are selected from the group consisting of: (i) the mature polypeptide of SEQ ID NO: 2, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 2; (ii) the mature polypeptide of SEQ ID NO: 5, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 5; (iii) the mature polypeptide of SEQ ID NO: 8, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 8; (iv) the mature polypeptide of SEQ ID NO: 11, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 11; (v) the mature polypeptide of SEQ ID NO: 14, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 14; (vi) the mature polypeptide of SEQ ID NO: 17, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 17; (vii) the mature polypeptide of SEQ ID NO: 20, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 20; (viii) the mature polypeptide of SEQ ID NO: 23, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 23; (ix) the mature polypeptide of SEQ ID NO: 26, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 26; (x) the mature polypeptide of SEQ ID NO: 29, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 29; (xi) the mature polypeptide of SEQ ID NO: 32, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 32; (xii) the mature polypeptide of SEQ ID NO: 35, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 35; (xiii) the mature polypeptide of SEQ ID NO: 38, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 38; (xiv) the mature polypeptide of SEQ ID NO: 41, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 41; (xv) the mature polypeptide of SEQ ID NO: 44, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 44; (xvi) the mature polypeptide of SEQ ID NO: 47, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 47; (xvii) the mature polypeptide of SEQ ID NO: 50, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 50; (xviii) the mature polypeptide of SEQ ID NO: 53, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 53; (xix) the mature polypeptide of SEQ ID NO: 56, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 56; (xx) the mature polypeptide of SEQ ID NO: 59, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 59; (xxi) the mature polypeptide of SEQ ID NO: 62, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 62; (xxii) the mature polypeptide of SEQ ID NO: 65, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 65; (xxiii) the mature polypeptide of SEQ ID NO: 68, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 68; (xxiv) the mature polypeptide of SEQ ID NO: 71, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 71; and (xxv) the mature polypeptide of SEQ ID NO: 74, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 74; (xxvi) the mature polypeptide of SEQ ID NO: 77, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 77; (xxvii) the mature polypeptide of SEQ ID NO: 80, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 80; (xxviii) the mature polypeptide of SEQ ID NO: 83, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 83; (xxix) the mature polypeptide of SEQ ID NO: 86, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 86; (xxx) the mature polypeptide of SEQ ID NO: 89, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 89; (xxxi) the mature polypeptide of SEQ ID NO: 92, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 92; (xxxii) the mature polypeptide of SEQ ID NO: 95, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 95; (xxxiii) the mature polypeptide of SEQ ID NO: 55, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 98; (xxxiv) the mature polypeptide of SEQ ID NO: 101, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 101; (xxxv) the mature polypeptide of SEQ ID NO: 104, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 104; (xxxvi) the mature polypeptide of SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 107; (xxxvii) the mature polypeptide of SEQ ID NO: 110, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 110; and (xxxviii) the mature polypeptide of SEQ ID NO: 113, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 113; and (xxxix) the mature polypeptide of SEQ ID NO: 116, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 116; (xl) the mature polypeptide of SEQ ID NO: 119, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 119; (xli) the mature polypeptide of SEQ ID NO: 144, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 144; (xlii) the mature polypeptide of SEQ ID NO: 147, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 147; (xliii) the mature polypeptide of SEQ ID NO: 150, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 150; and (xliv) the mature polypeptide of SEQ ID NO: 153, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 153.

In an embodiment, a polypeptide having beta-1,6-glucanase activity from the GH5_15 family and a polypeptide having beta-1,3-glucanase activity from the GH64 family are present and/or added during saccharification, fermentation, or SSF, or are used as a component of an enzyme blend or composition of the invention. In an embodiment, a polypeptide having beta-1,6-glucanase activity from the GH5_15 family and a polypeptide having beta-1,3-glucanase activity from the GH64 family are present and/or added during saccharification, fermentation, or SSF, or are a component of an enzyme blend or composition of the invention, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, and wherein the polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, SEQ ID NO: 153, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, SEQ ID NO: 83, or SEQ ID NO: 153.

In an embodiment, a polypeptide having beta-1,6-glucanase activity from the GH5_15 family and a polypeptide having beta-1,6-glucanase activity and/or beta-1,3-glucanase activity from the GH131 family are present and/or added during saccharification, fermentation, or SSF, or are used as a component of an enzyme blend or composition of the invention. In an embodiment, a polypeptide having beta-1,6-glucanase activity from the GH5_15 family and a polypeptide having beta-1,3-glucanase activity from the GH64 family are present and/or added during saccharification, fermentation, or SSF, or are used as a component of an enzyme blend or composition of the invention, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and wherein the polypeptide having beta-1,6-glucanase activity and/or beta-1,3-glucanase activity from the GH131 family is selected from the group consisting of the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74.

In an embodiment, a polypeptide having beta-1,3-glucanase activity from the GH16 family family and a polypeptide having beta-1,3-glucanase activity from the GH55_3 family are present and/or added during saccharification, fermentation, or SSF, or are used as a component of an enzyme blend or composition of the invention. In an embodiment, a polypeptide having beta-1,3-glucanase activity from the GH16 family and a polypeptide having beta-1,3-glucanase activity from the GH55_3 family are present and/or added during saccharification, fermentation, or SSF, or are used as a component of an enzyme blend or composition of the invention, wherein the polypeptide having beta-1,3-glucanase activity from the GH16 family is selected from the group consisting of the mature polypeptide of SEQ ID NO: 20, SEQ ID NO: 23, SEQ ID NO: 26, SEQ ID NO: 29, SEQ ID NO: 86, SEQ ID NO: 89, SEQ ID NO: 144, SEQ ID NO: 147 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 20, SEQ ID NO: 23, SEQ ID NO: 26, SEQ ID NO: 29, SEQ ID NO: 86, SEQ ID NO: 89, SEQ ID NO: 144, or SEQ ID NO: 147, and wherein the polypeptide having beta-1,3-glucanase activity from the GH55_3 family is the mature polypeptide of SEQ ID NO: 5, SEQ ID NO: 107, or SEQ ID NO: 153, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5, SEQ ID NO: 107, or SEQ ID NO: 153.

In an embodiment, a polypeptide having beta-1,6-glucanase activity from the GH5_15 family and a polypeptide having beta-1,3-glucanase activity from the GH30_3 family are present and/or added during saccharification, fermentation, or SSF, or are used as a component of an enzyme blend or composition of the invention. In an embodiment, a polypeptide having beta-1,6-glucanase activity from the GH5_15 family and a polypeptide having beta-1,3-glucanase activity from the GH30_3 family are present and/or added during saccharification, fermentation, or SSF, or are used as a component of an enzyme blend or composition of the invention, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and wherein the polypeptide having beta-1,3-glucanase activity from the GH30_3 family is selected from the group consisting of the mature polypeptide of SEQ ID NO: 32, SEQ ID NO: 80, SEQ ID NO: 119, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 32, SEQ ID NO: 80, or SEQ ID NO: 119.

In an embodiment, a polypeptide having beta-1,6-glucanase activity from the GH5_15 family, a polypeptide having beta-1,3-glucanase activity from the GH30_3 family, and a polypeptide having beta-1,3-glucanase activity from the GH16 family are present and/or added during saccharification, fermentation, or SSF, or are used as a component of an enzyme blend or composition of the invention. In an embodiment, a polypeptide having beta-1,6-glucanase activity from the GH5_15 family, a polypeptide having beta-1,3-glucanase activity from the GH30_3 family, and a polypeptide having beta-1,3-glucanase activity from the GH16 family are present and/or added during saccharification, fermentation, or SSF, or are used as a component of an enzyme blend or composition of the invention, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, wherein the polypeptide having beta-1,3-glucanase activity from the GH30_3 family is selected from the group consisting of the mature polypeptide of SEQ ID NO: 32, SEQ ID NO: 80, SEQ ID NO: 119, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 32, SEQ ID NO: 80, or SEQ ID NO: 119, and wherein the polypeptide having beta-1,3-glucanase activity from the GH16 family is selected from the group consisting of the mature polypeptide of SEQ ID NO: 20, SEQ ID NO: 23, SEQ ID NO: 26, SEQ ID NO: 29, SEQ ID NO: 86, SEQ ID NO: 89, SEQ ID NO: 144, SEQ ID NO: 147 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 20, SEQ ID NO: 23, SEQ ID NO: 26, SEQ ID NO: 29, SEQ ID NO: 86, SEQ ID NO: 89, SEQ ID NO: 144 or SEQ ID NO: 147.

In an embodiment, a polypeptide having beta-1,6-glucanase activity from the GH5_15 family, a polypeptide having beta-1,3-glucanase activity from the GH64 family, and a polypeptide having beta-1,3-glucanase activity from the GH16 family are present and/or added during saccharification, fermentation, or SSF, or are used as a component of an enzyme blend or composition of the invention. In an embodiment, a polypeptide having beta-1,6-glucanase activity from the GH5_15 family, a polypeptide having beta-1,3-glucanase activity from the GH64 family, and a polypeptide having beta-1,3-glucanase activity from the GH16 family are present and/or added during saccharification, fermentation, or SSF, or are used as a component of an enzyme blend or composition of the invention, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, wherein the polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, SEQ ID NO: 153, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, SEQ ID NO: 83, or SEQ ID NO: 153, and wherein polypeptide having beta-1,3-glucanase activity from the GH16 family is selected from the group consisting of the mature polypeptide of SEQ ID NO: 20, SEQ ID NO: 23, SEQ ID NO: 26, SEQ ID NO: 29, SEQ ID NO: 86, SEQ ID NO: 89, SEQ ID NO: 144, SEQ ID NO: 147 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 20, SEQ ID NO: 23, SEQ ID NO: 26, SEQ ID NO: 29, SEQ ID NO: 86, SEQ ID NO: 89, SEQ ID NO: 144 or SEQ ID NO: 147.

In an embodiment, a polypeptide having beta-1,6-glucanase activity from the GH5_15 family and a polypeptide having beta-1,3-glucanase activity from the GH55_3 family are present and/or added during saccharification, fermentation, or SSF, or are used as a component of an enzyme blend or composition of the invention. In an embodiment, a polypeptide having beta-1,6-glucanase activity from the GH5_15 family and a polypeptide having beta-1,3-glucanase activity from the GH55_3 family are present and/or added during saccharification, fermentation, or SSF, or are used as a component of an enzyme blend or composition of the invention wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, wherein the polypeptide having beta-1,3-glucanase activity from the GH55_3 family is the mature polypeptide of SEQ ID NO: 5, SEQ ID NO: 107, SEQ ID NO: 110, SEQ ID NO: 113, SEQ ID NO: 116, SEQ ID NO: 150, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5, SEQ ID NO: 107, SEQ ID NO: 110, SEQ ID NO: 113, SEQ ID NO: 116, or SEQ ID NO: 150.

In an embodiment, a polypeptide having beta-1,3-glucanase activity from the GH55_3 family and a polypeptide having beta-1,3-glucanase activity from the GH64 family are present and/or added during saccharification, fermentation, or SSF, or are used as a component of an enzyme blend or composition of the invention. In an embodiment, a polypeptide having beta-1,3-glucanase activity from the GH55_3 family and a polypeptide having beta-1,3-glucanase activity from the GH64 family are present and/or added during saccharification, fermentation, or SSF, or are used as a component of an enzyme blend or composition of the invention, wherein the polypeptide having beta-1,3-glucanase activity from the GH55_3 family is the mature polypeptide of SEQ ID NO: 5, SEQ ID NO: 107, SEQ ID NO: 110, SEQ ID NO: 113, SEQ ID NO: 116, SEQ ID NO: 150, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5, SEQ ID NO: 107, SEQ ID NO: 110, SEQ ID NO: 113, SEQ ID NO: 116, SEQ ID NO: 150 and wherein the polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, SEQ ID NO: 153, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, SEQ ID NO: 83, or SEQ ID NO: 153.

In an embodiment, a polypeptide having beta-1,6-glucanase activity from the GH5_15 family, a polypeptide having beta-1,3-glucanase activity from the GH55_3 family, and a polypeptide having beta-1,3-glucanase activity from the GH64 family are present and/or added during saccharification, fermentation, or SSF, or used as a component of an enzyme blend or composition of the invention. In an embodiment, a polypeptide having beta-1,6-glucanase activity from the GH5_15 family, a polypeptide having beta-1,3-glucanase activity from the GH55_3 family, and a polypeptide having beta-1,3-glucanase activity from the GH64 family are present and/or added during saccharification, fermentation, or SSF, or used as a component of an enzyme blend or composition of the invention, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, wherein the polypeptide having beta-1,3-glucanase activity from the GH55_3 family is the mature polypeptide of SEQ ID NO: 5, SEQ ID NO: 107, SEQ ID NO: 110, SEQ ID NO: 113, SEQ ID NO: 116, SEQ ID NO: 150, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5, SEQ ID NO: 107, SEQ ID NO: 110, SEQ ID NO: 113, SEQ ID NO: 116, or SEQ ID NO: 150, and wherein polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, SEQ ID NO: 153, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, SEQ ID NO: 83, or SEQ ID NO: 153.

In an embodiment, a polypeptide having beta-1,3-glucanase activity from the GH16 family and a polypeptide having beta-1,3-glucanase activity from the GH64 family are present and/or added during saccharification, fermentation, or SSF, or are used as a component of an enzyme blend or composition of the invention. In an embodiment, a polypeptide having beta-1,3-glucanase activity from the GH16 family and a polypeptide having beta-1,3-glucanase activity from the GH64 family are present and/or added during saccharification, fermentation, or SSF, or used as a component of an enzyme blend or composition of the invention, wherein the polypeptide having beta-1,3-glucanase activity from the GH16 family is selected from the group consisting of the mature polypeptide of SEQ ID NO: 20, SEQ ID NO: 23, SEQ ID NO: 26, SEQ ID NO: 29, SEQ ID NO: 86, SEQ ID NO: 89, SEQ ID NO: 144, SEQ ID NO: 147, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 20, SEQ ID NO: 23, SEQ ID NO: 26, SEQ ID NO: 29, SEQ ID NO: 86, SEQ ID NO: 89, SEQ ID NO: 144, or SEQ ID NO: 147, and wherein the polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, SEQ ID NO: 153 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, SEQ ID NO: 83, or SEQ ID NO: 153.

In an embodiment, a polypeptide having beta-1,6-glucanase activity from the GH131 family and a polypeptide having beta-1,3-glucanase activity from the GH131 family, or an enzyme blend or composition comprising said polypeptides are present and/or added during saccharification, fermentation, or SSF, or used as a component of an enzyme blend or composition of the invention. In an embodiment, the process, enzyme blend or composition comprises at least two, at least three, at least four, or at least five polypeptides having beta-1,6-glucanase activity and/or beta-1,3-glucanase activity selected from the group consisting of the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74.

In an embodiment, the mature polypeptide of SEQ ID NO: 5 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5 and the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38 are present and/or added during saccharification, fermentation, or SSF, or are used as a component of an enzyme blend or composition of the invention.

In an embodiment, the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107 and the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38 are present and/or added during saccharification, fermentation, or SSF, or are used as a component of an enzyme blend or composition of the invention.

In an embodiment, the mature polypeptide of SEQ ID NO: 8 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8 and the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38 are present and/or added during saccharification, fermentation, or SSF, or are used as a component of an enzyme blend or composition of the invention.

In an embodiment, the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11 and the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38 are present and/or added during saccharification, fermentation, or SSF, or are used as a component of an enzyme blend or composition of the invention.

In an embodiment, the mature polypeptide of SEQ ID NO: 8 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, the mature polypeptide of SEQ ID NO: 23 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 23, and the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38, are present and/or added during saccharification, fermentation, or SSF, or used as a component of an enzyme blend or composition of the invention.

In an embodiment, the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11, the mature polypeptide of SEQ ID NO: 23 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 23, and the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38, are present and/or added during saccharification, fermentation, or SSF, or used as a component of an enzyme blend or composition of the invention.

In an embodiment, the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11, and the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38 are present and/or added during saccharification, fermentation, or SSF, or used as a component of an enzyme blend or composition of the invention.

In an embodiment, a composition or enzyme blend of the invention, which can be used in a saccharifying step, fermenting step, or simultaneous saccharification and fermentation step of a process of the present invention, comprises:
(i) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(ii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and (iii) a cellulolytic composition selected from the group consisting of:

(a) *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124; and (b) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, a composition or enzyme blend of the invention, which can be used in a saccharifying step, fermenting step, or simultaneous saccharification and fermentation step of a process of the present invention, comprises:

(i) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(ii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38;

(iii) a cellulolytic composition selected from the group consisting of:

(a) *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124; and (b) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus Aspergillus, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125;

(iv) a polypeptide having trehalase activity selected from the group consisting of:

a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137 and having trehalase activity; and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 138 and having trehalase activity; and (v) a glucoamylase blend selected from the group consisting of:

a blend comprising *Gloeophyllum sepiarium* glucoamylase shown as SEQ ID NO: 134, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134, and an alpha-amylase from *Rhizomucor pusillus* with an *Aspergillus niger* glucoamylase linker and starch-binding domain (SBD), disclosed SEQ ID NO: 136 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136; and a blend comprising *Talaromyces emersonii* glucoamylase of SEQ ID NO: 132, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 132, a *Trametes cingulata* glucoamylase of SEQ ID NO: 131, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 131, and a *Rhizomucor pusillus* alpha-amylase with an *Aspergillus niger* glucoamylase linker and starch-binding domain (SBD), of SEQ ID NO: 136, and comprising the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

In an embodiment, the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11, and the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107 are present and/or added during saccharification, fermentation, or SSF, or used as a component of an enzyme blend or composition of the invention.

In an embodiment, a composition or enzyme blend of the invention, which can be used in a saccharifying step, fermenting step, or simultaneous saccharification and fermentation step of a process of the present invention, comprises:
 (i) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;
 (ii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107; and
 (iii) a cellulolytic composition selected from the group consisting of:
 (a) *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124; and (b) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, a composition or enzyme blend of the invention, which can be used in a saccharifying step, fermenting step, or simultaneous saccharification and fermentation step of a process of the present invention, comprises:

(i) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(ii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107;

(iii) a cellulolytic composition selected from the group consisting of:

(a) *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124; and (b) a *Trichoderma reesei* cellulolytic enzyme composition further comprising:
   an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;
   a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and
   an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125;

(iv) a polypeptide having trehalase activity selected from the group consisting of:
   a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137 and having trehalase activity; and
   a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 138 and having trehalase activity; and (vi) a glucoamylase blend selected from the group consisting of:
   a blend comprising *Gloeophyllum sepiarium* glucoamylase shown as SEQ ID NO: 134, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134, and an alpha-amylase from *Rhizomucor pusillus* with an *Aspergillus niger* glucoamylase linker and starch-binding domain (SBD), disclosed SEQ ID NO: 136 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136; and a blend comprising *Talaromyces emersonii* glucoamylase of SEQ ID NO: 132, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 132, a *Trametes cingulata* glucoamylase of SEQ ID NO: 131, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 131, and a *Rhizomucor pusillus* alpha-amylase with an *Aspergillus niger* glucoamylase linker and starch-binding domain (SBD), of SEQ ID NO: 136, and comprising the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

In an embodiment, the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38, and the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107 are present and/or added during saccharification, fermentation, or SSF, or used as a component of an enzyme blend or composition of the invention.

In an embodiment, a composition or enzyme blend of the invention, which can be used in a saccharifying step, fermenting step, or simultaneous saccharification and fermentation step of a process of the present invention, comprises:
  (i) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38;
  (ii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107; and
  (iii) a cellulolytic composition selected from the group consisting of:
  (a) *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124; and (b) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, a composition or enzyme blend of the invention, which can be used in a saccharifying step, fermenting step, or simultaneous saccharification and fermentation step of a process of the present invention, comprises:

(i) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38;

(ii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107;

(iii) a cellulolytic composition selected from the group consisting of:

(a) *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124; and (b) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125;

(iv) a polypeptide having trehalase activity selected from the group consisting of:

a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137 and having trehalase activity; and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 138 and having trehalase activity; and (vii) a glucoamylase blend selected from the group consisting of:

a blend comprising *Gloeophyllum sepiarium* glucoamylase shown as SEQ ID NO: 134, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134, and an alpha-amylase from *Rhizomucor pusillus* with an *Aspergillus niger* glucoamylase linker and starch-binding domain (SBD), disclosed SEQ ID NO: 136 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136; and a blend comprising *Talaromyces emersonii* glucoamylase of SEQ ID NO: 132, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 132, a *Trametes cingulata* glucoamylase of SEQ ID NO: 131, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 131, and a *Rhizomucor pusillus* alpha-amylase with an *Aspergillus niger* glucoamylase linker and starch-binding domain (SBD), of SEQ ID NO: 136, and comprising the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

In an embodiment, the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11, the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38, and the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107, are present and/or added during saccharification, fermentation, or SSF, or used as a component of an enzyme blend or composition of the invention.

In an embodiment, a composition or enzyme blend of the invention, which can be used in a saccharifying step, fermenting step, or simultaneous saccharification and fermentation step of a process of the present invention, comprises:

(i) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(ii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38;

(iii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107; and (iv) a cellulolytic composition selected from the group consisting of:

(a) *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124; and (b) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, a composition or enzyme blend of the invention, which can be used in a saccharifying step, fermenting step, or simultaneous saccharification and fermentation step of a process of the present invention, comprises:

(i) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(ii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38;

(iii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107;

(iv) a cellulolytic composition selected from the group consisting of:

(a) *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124; and (b) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125;

(v) a polypeptide having trehalase activity selected from the group consisting of:

a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137 and having trehalase activity; and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 138 and having trehalase activity; and (vi) a glucoamylase blend selected from the group consisting of:

a blend comprising *Gloeophyllum sepiarium* glucoamylase shown as SEQ ID NO: 134, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134, and an alpha-amylase from *Rhizomucor pusillus* with an *Aspergillus niger* glucoamylase linker and starch-binding domain (SBD), disclosed SEQ ID NO: 136 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136; and a blend comprising *Talaromyces emersonii* glucoamylase of SEQ ID NO: 132, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 132, a *Trametes cingulata* glucoamylase of SEQ ID NO: 131, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 131, and a *Rhizomucor pusillus* alpha-amylase with an *Aspergillus niger* glucoamylase linker and starch-binding domain (SBD), of SEQ ID NO: 136, and comprising the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

In some embodiments, the at least one polypeptide having beta-1,6-glucanase activity comprises at least one, at least two, at least three, at least four, or at least five polypeptides having beta-1,6-glucanase activity selected from the group consisting of: (i) the mature polypeptide of SEQ ID NO: 2, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to SEQ ID NO: 2; (ii) the mature polypeptide of SEQ ID NO: 32, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 32; (iii) the mature polypeptide of SEQ ID NO: 35, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 35; (iv) the mature polypeptide of SEQ ID NO: 38, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 38; (v) the mature polypeptide of SEQ ID NO: 41, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 41; (vi) the mature polypeptide of SEQ ID NO: 44, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 44; (vii) the mature polypeptide of SEQ ID NO: 47, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 47; (vii) the mature polypeptide of SEQ ID NO: 50, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 50; (viii) the mature polypeptide of SEQ ID NO: 53, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 53; (ix) the mature polypeptide of SEQ ID NO: 56, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 56; (x) the mature polypeptide of SEQ ID NO: 59, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 59; (xi) the mature polypeptide of SEQ ID NO: 62, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 62; (xii) the mature polypeptide of SEQ ID NO: 65, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 65; (xiii) the mature polypeptide of SEQ ID NO: 68, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 68; (xiv) polypeptide of SEQ ID NO: 71, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 71; (xv) the mature polypeptide of SEQ ID NO: 74, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 74; (xvi) the mature polypeptide of SEQ ID NO: 77, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 77; (xvii) the mature polypeptide of SEQ ID NO: 80, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 80; (xviii) the mature polypeptide of SEQ ID NO: 92, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 92; (xix) the mature polypeptide of SEQ ID NO: 95, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 95; (xx) the mature polypeptide of SEQ ID NO: 98, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 98; (xxi) the mature polypeptide of SEQ ID NO: 101, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 101; (xxii) the mature polypeptide of SEQ ID NO: 104, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 104; and (xxiii) the mature polypeptide of SEQ ID NO: 119, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 119.

In some embodiments, the at least one polypeptide having beta-1,3-glucanase activity comprises at least one, at least two, at least three, at least four, or at least five polypeptides having beta-1,3-glucanase activity selected from the group consisting of: (i) the mature polypeptide of SEQ ID NO: 5, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 5; (ii)

the mature polypeptide of SEQ ID NO: 8, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 8; (iii) the mature polypeptide of SEQ ID NO: 11, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity or at least 99% identity to SEQ ID NO: 11; (iv) the mature polypeptide of SEQ ID NO: 14, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 14; (v) the mature polypeptide of SEQ ID NO: 17, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 17; (vi) the mature polypeptide of SEQ ID NO: 20, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 20; (vii) the mature polypeptide of SEQ ID NO: 23, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 23; (viii) the mature polypeptide of SEQ ID NO: 26, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 26; (ix) the mature polypeptide of SEQ ID NO: 29, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 29; (x) the mature polypeptide of SEQ ID NO: 44, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 44; (xi) the mature polypeptide of SEQ ID NO: 47, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 47; (xii) the mature polypeptide of SEQ ID NO: 50, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 50; (xiii) the mature polypeptide of SEQ ID NO: 53, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 53; (xiv) the mature polypeptide of SEQ ID NO: 56, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 56; (xv) the mature polypeptide of SEQ ID NO: 59, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 59; (xvi) the mature polypeptide of SEQ ID NO: 62, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 62; (xvii) the mature polypeptide of SEQ ID NO: 65, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 65; (xviii) the mature polypeptide of SEQ ID NO: 68, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 68; (xix) the mature polypeptide of SEQ ID NO: 71, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 71; (xx) the mature polypeptide of SEQ ID NO: 74, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 74; (xxi) the mature polypeptide of SEQ ID NO: 83, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 83; (xxii) the mature polypeptide of SEQ ID NO: 86, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 86; (xxiii) the mature polypeptide of SEQ ID NO: 89, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 89; (xxiv) the mature polypeptide of SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 107; (xxv) the mature polypeptide of SEQ ID NO: 110, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 110; (xxvi) the mature polypeptide of SEQ ID NO: 113, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 113; (xxvii) the mature polypeptide of SEQ ID NO: 116, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 116; (xxviii) the mature polypeptide of SEQ ID NO: 144, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 144; (xxix) the mature polypeptide of SEQ ID NO: 147, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 147; (xxx) the mature polypeptide of SEQ ID NO: 150, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 150; and (xxxi) the mature polypeptide of SEQ ID NO: 153, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 153.

The beta-glucanases may be added/be present in any amounts, however, preferably the at least one polypeptide having beta-1,6-glucanase activity and the at least one polypeptide having beta-1,3-glucanase activity is present/added in a ratio based on beta-1,6-glucanase activity to beta-1,3-glucanase activity of 1:10; 1:5; 1:2.5; 1:2; 1:1.5:1:1; 1:0.9; 1:0.8; 1:0.7; 1:0.6; 1:0.5; 1:0.4; 1:0.3; 1:0.2.

In terms of dose ranges envisaged according to the invention, in one embodiment, the at least one polypeptide having beta-1,6-glucanase activity and/or the at least one polypeptide having beta-1,3-glucanase activity are dosed in the range 0.1-1000 micro gram EP/g DS; 0.5-500 micro gram EP/g DS; 1-100 micro gram EP/g DS; such as 5-50 micro gram EP/g DS.

According to the invention at least one polypeptide having beta-1,6-glucanase activity and/or at least one polypeptide having endo- and/or exo-beta-1,3-glucanase activity are present or added during fermentation or simultaneous saccharification and fermentation, or used as a component of an enzyme blend or composition of the invention, however, preferred embodiments may also include the addition of other enzyme classes during fermentation/SSF, or as a component of an enzyme blend or composition of the invention. Examples of other enzymes that can be added during fermentation/SSF, or used as a component of an enzyme blend or composition of the invention include, without limitation, alpha-amylases, glucoamylases, trehalases, cellulases/cellulolytic compositions. Particularly, saccharification and/or fermentation or simultaneous saccharification and fermentation, is performed in the presence of at least one cellulase/cellulolytic composition. More particularly the cellulases/cellulolytic composition are derived from a strain of Trichoderma, in particular Trichoderma reesei, or a strain of Humicola, in particular Humicola insolens, or a strain of Chrysosporium, in particular Chrysosporium lucknowense. The cellulases/cellulolytic composition should at least comprise a beta-glucosidase, a cellobiohydrolase and an endoglucanase.

In one embodiment, the cellulases/cellulolytic composition comprises one or more polypeptides selected from the group consisting of:
  GH61 polypeptide having cellulolytic enhancing activity, beta-glucosidase;
  Cellobiohydrolase I;
  Cellobiohydrolase II;
  or a mixture of two, three, or four thereof.

In an embodiment, the cellulase/cellulolytic composition comprises a beta-glucosidase, a cellobiohydrolase 1, and an endoglucanase 1.

Cellulases are well known in the art, and many are derived from filamentous fungi. Particularly, according to the invention, the cellulases/cellulolytic composition comprises one or more of the following components:
  (i) an Aspergillus fumigatus cellobiohydrolase I;
  (ii) an Aspergillus fumigatus cellobiohydrolase 11;
  (iii) an Aspergillus fumigatus beta-glucosidase or variant thereof; and
  (iv) a Penicillium sp. GH61 polypeptide having cellulolytic enhancing activity; or homologs thereof.

More specifically the cellulases/cellulolytic composition is in one embodiment a Trichoderma reesei cellulolytic enzyme composition further comprising Penicillium emersonii GH61A polypeptide having cellulolytic enhancing activity disclosed in SEQ ID NO: 121, or a polypeptide having at least 80%, at least 85%, at least 90% identity, at least 95% identity, at least 96% identity, at least 97% identity, at least 99% identity to SEQ ID NO: 121 and an Aspergillus fumigatus beta-glucosidase disclosed in SEQ ID NO: 122 or a variant thereof with the following substitutions: F100D, S283G, N456E, F512Y having at least 90% identity, at least 95% identity, at least 96% identity, at least 97% identity, at least 99% identity to SEQ ID NO: 122. In one embodiment, the cellulolytic composition comprises a cellobiohydrolase I (CBH I), such as one derived from a strain of the genus Aspergillus, such as a strain of Aspergillus fumigatus, such as the CBHI disclosed as SEQ ID NO: 123, or CBH I having at least 80%, at least 85%, at least 90% identity, at least 95% identity, at least 96% identity, at least 97% identity, at least 99% identity to SEQ ID NO: 123.

In one embodiment, the cellulolytic composition comprises a cellobiohydrolase II (CBH 11), such as one derived from a strain of the genus Aspergillus, such as a strain of Aspergillus fumigatus; such as the CBH II disclosed as SEQ ID NO: 124, or a CBH II having at least 80%, at least 85%, at least 90% identity, at least 95% identity, at least 96% identity, at least 97% identity, at least 99% identity to SEQ ID NO: 124.

In another embodiment, the cellulases/cellulolytic composition is a Trichoderma reesei cellulolytic enzyme composition further comprising an endoglucanase I (EGI), such as one derived from a strain of the genus Trichoderma, such as a strain of Trichoderma reesei, such as the EGI disclosed as SEQ ID NO: 125, or an EGI having at least 80%, at least 85%, at least 90% identity, at least 95% identity, at least 96% identity, at least 97% identity, at least 99% identity to SEQ ID NO: 125.

Examples of suitable cellulases can be found in "Cellulolytic Composition present and/or added during Saccharification and/or Fermentation"

Examples of alpha-amylases can be found in the "Alpha-Amylase Present and/or Added During Liquefaction"-section below. Examples of thermostable proteases can be found in the "Protease Present and/or Added During Liquefaction"-section below. Examples of suitable optional carbohydrate-source generating enzymes, preferably thermostable carbohydrate-source generating enzymes, in particular, a thermostable glucoamylase, can be found in the "Carbohydrate-Source Generating Enzymes Present and/or Added During Liquefaction"-section below.

The pH during liquefaction may be between 4-7. In an embodiment, the pH during liquefaction is from 4.5-5.0, such as between 4.5-4.8. In another embodiment liquefaction is carried out at a pH above 5.0-6.5, such as above 5.0-6.0, such as above 5.0-5.5, such as between 5.2-6.2, such as around 5.2, such as around 5.4, such as around 5.6, such as around 5.8.

According to the invention the temperature is above the initial gelatinization temperature. The term "initial gelatinization temperature" refers to the lowest temperature at which solubilization of starch, typically by heating, begins. The temperature can vary for different starches.

In an embodiment, the temperature during liquefaction step i) is in the range from 70-100° C., such as between 75-100° C., preferably between 80-100° C., such as between 85-95° C., such as around between 88 and 92° C. In an embodiment, the temperature during liquefaction step i) is at least 80° C. In an embodiment, the temperature during liquefaction step i) is at least 81° C. In an embodiment, the temperature during liquefaction step i) is at least 82° C. In an embodiment, the temperature during liquefaction step i) is at least 83° C. In an embodiment, the temperature during liquefaction step i) is at least 84° C. In an embodiment, the temperature during liquefaction step i) is at least 85° C. In an embodiment, the temperature during liquefaction step i) is at least 86° C. In an embodiment, the temperature during liquefaction step i) is at least 87° C. In an embodiment, the temperature during liquefaction step i) is at least 88° C. In an embodiment, the temperature during liquefaction step i) is at least 89° C. In an embodiment, the temperature during liquefaction step i) is at least 90° C. In an embodiment, the temperature during liquefaction step i) is at least 91° C. In an embodiment, the temperature during liquefaction step i) is at least 92° C. In an embodiment, the temperature during liquefaction step i) is at least 93° C. In an embodiment, the temperature during liquefaction step i) is at least 94° C. In an embodiment, the temperature during liquefaction step i) is at least 95° C. In an embodiment, the temperature during liquefaction step i) is at least 96° C. In an embodiment, the temperature during liquefaction step i) is at least 97° C. In an embodiment, the temperature during liquefaction step i) is at least 97° C. In an embodiment, the temperature during liquefaction step i) is at least 98° C. In an embodiment, the temperature during liquefaction step i) is at least 99° C. In an embodiment, the temperature during liquefaction step i) is at least 100° C.

In an embodiment, the process of the invention further comprises, prior to the step i), the steps of:
a) reducing the particle size of the starch-containing material, preferably by dry milling;
b) forming a slurry comprising the starch-containing material and water.

The starch-containing starting material, such as whole grains, may be reduced in particle size, e.g., by milling, in order to open up the structure, to increase surface area, and allowing for further processing. Generally, there are two types of processes: wet and dry milling. In dry milling whole kernels are milled and used. Wet milling gives a good separation of germ and meal (starch granules and protein). Wet milling is often applied at locations where the starch hydrolysate is used in production of, e.g., syrups. Both dry and wet milling are well known in the art of starch processing. According to the present invention dry milling is preferred. In an embodiment, the particle size is reduced to between 0.05 to 3.0 mm, preferably 0.1-0.5 mm, or so that at least 30%, preferably at least 50%, more preferably at least 70%, even more preferably at least 90% of the starch-containing material fit through a sieve with a 0.05 to 3.0 mm screen, preferably 0.1-0.5 mm screen. In another embodiment, at least 50%, preferably at least 70%, more preferably at least 80%, especially at least 90% of the starch-containing material fit through a sieve with #6 screen.

The aqueous slurry may contain from 10-55 w/w-% dry solids (DS), preferably 25-45 w/w-% dry solids (DS), more preferably 30-40 w/w-% dry solids (DS) of starch-containing material.

The alpha-amylase, optional thermostable protease, optional carbohydrate-source generating enzyme, in particular thermostable glucoamylase, may initially be added to the aqueous slurry to initiate liquefaction (thinning). In an embodiment only a portion of the enzymes is added to the aqueous slurry, while the rest of the enzymes are added during liquefaction step i).

Liquefaction step i) is according to the invention carried out for 0.5-5 hours, such as 1-3 hours, such as typically around 2 hours.

The aqueous slurry may in an embodiment be jet-cooked to further gelatinize the slurry before being subjected to liquefaction in step i). The jet-cooking may be carried out at a temperature between 110-145° C., preferably 120-140° C., such as 125-135° C., preferably around 130° C. for about 1-15 minutes, preferably for about 3-10 minutes, especially around about 5 minutes.

Saccharification and Fermentation

One or more carbohydrate-source generating enzymes, in particular glucoamylase, may be present and/or added during saccharification step ii) and/or fermentation step iii). The carbohydrate-source generating enzyme may preferably be a glucoamylase, but may also be an enzyme selected from the group consisting of: beta-amylase, maltogenic amylase and alpha-glucosidase. The carbohydrate-source generating enzyme added during saccharification step ii) and/or fermentation step iii) is typically different from the optional carbohydrate-source generating enzyme, in particular thermostable glucoamylase, optionally added during liquefaction step i). In a preferred embodiment the carbohydrate-source generating enzymes, in particular glucoamylase, is added together with a fungal alpha-amylase.

Examples of carbohydrate-source generating enzymes, including glucoamylases, can be found in the "Carbohydrate-Source Generating Enzyme Present and/or Added During Saccharification and/or Fermentation"-section below.

One or more alpha-amylases may be present and/or added during saccharification step ii) and/or fermentation step iii). In an embodiment, the alpha-amylase is the *Rhizomucor pusillus* alpha-amylase with *Aspergillus niger* glucoamylase linker and SBD disclosed as SEQ ID NO: 136 with the following substitutions: G128D+D143N (activity ratio AGU:AGU:FAU(F): approx. 30:7:1).

One or more trehalases may be present and/or added during saccharification step ii) and/or fermentation step iii). In an embodiment, the trehalase is the *Talaromyces funiculosus* trehalase disclosed herein as SEQ ID NO: 137 or a polypeptide having at least 80%, at least 85%, at least 90% identity, at least 95% identity, at least 96% identity, at least 97% identity, at least 99% identity to SEQ ID NO: 137, which has trehalase activity.

In an embodiment, the trehalase is part of a blend comprising *Gloeophyllum sepiarium* glucoamylase disclosed in SEQ ID NO: 134 or a polypeptide having at least 80%, at least 85%, at least 90% identity, at least 95% identity, at least 96% identity, at least 97% identity, at least 99% identity to SEQ ID NO: 134, which has gluocamylase activity, *Talaromyces funiculosus* trehalase disclosed herein as SEQ ID NO: 137, or a polypeptide having at least 80%, at least 85%, at least 90% identity, at least 95% identity, at least 96% identity, at least 97% identity, at least 99% identity to SEQ ID NO: 137, which has trehalase activity, and *Rhizomucor pusillus* alpha-amylase with *Aspergillus niger* glucoamylase linker and SBD disclosed as SEQ ID NO: 136 with the following substitutions: G128D+D143N (activity ratio AGU:AGU:FAU(F): approx. 30:7:1), or a polypeptide having at least 80%, at least 85%, at least 90% identity, at least 95% identity, at least 96% identity, at least 97% identity, at least 99% identity to SEQ ID NO: 136, which has alpha-amylase activity.

When doing sequential saccharification and fermentation, saccharification step ii) may be carried out at conditions well-known in the art. For instance, the saccharification step ii) may last up to from about 24 to about 72 hours. In an embodiment, pre-saccharification is done. Pre-saccharification is typically done for 40-90 minutes at a temperature between 30-65° C., typically about 60° C. Pre-saccharification is in an embodiment followed by saccharification during fermentation in simultaneous saccharification and fermentation ("SSF). Saccharification is typically carried out at temperatures from 20-75° C., preferably from 40-70° C., typically around 60° C., and at a pH between 4 and 5, normally at about pH 4.5.

Simultaneous saccharification and fermentation ("SSF") is widely used in industrial scale fermentation product production processes, especially ethanol production processes. When doing SSF the saccharification step ii) and the fermentation step iii) are carried out simultaneously. There is no holding stage for the saccharification, meaning that a fermenting organism, such as yeast, and enzyme(s), may be added together. However, it is also contemplated to add the fermenting organism and enzyme(s) separately. SSF is according to the invention typically carried out at a temperature from 25° C. to 40° C., such as from 28° C. to 35° C., such as from 30° C. to 34° C., preferably around about 32° C. In an embodiment fermentation is ongoing for 6 to 120 hours, in particular 24 to 96 hours. In an embodiment the pH is between 3.5-5, in particular between 3.8 and 4.3.

In an embodiment, the at least one polypeptide having beta-1,6-glucanase activity and/or at least one polypeptide having endo- and/or exo-beta-1,3-glucanase activity have a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having beta-1,6-glucanase activity, e.g., from the GH30_3 family, GH5_15 family, and/or GH131 family, has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having beta-1,3-glucanase activity, e.g., from the GH16, GH55_3, GH64 and GH131, has a pH optimum of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5.

In an embodiment, the at least one polypeptide having beta-1,6-glucanase activity and/or at least one polypeptide having endo- and/or exo-beta-1,3-glucanase activity have an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having beta-1,6-glucanase activity, e.g., from the GH30_3 family, GH5_15 family, and/or GH131 family, has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5. In an embodiment, the at least one polypeptide having beta-1,3-glucanase activity, e.g., from the GH16, GH55_3, GH64 and GH131, has an isoelectric point (Pi) of less than 8.0, less than 7.5, less than 7.0, less than 6.5, less than 6.0, less than 5.5, less than or equal to about 5.0, less than or equal to about 4.9, less than or equal to about 4.9, less than or equal to about 4.8, less than or equal to about 4.8, less than or equal to about 4.7, less than or equal to about 4.6, or less than or equal to about 4.5.

Methods Using a Cellulosic-Containing Material

In some aspects, the methods described herein produce a fermentation product from a cellulosic-containing material. The predominant polysaccharide in the primary cell wall of biomass is cellulose, the second most abundant is hemicellulose, and the third is pectin. The secondary cell wall, produced after the cell has stopped growing, also contains polysaccharides and is strengthened by polymeric lignin covalently cross-linked to hemicellulose. Cellulose is a homopolymer of anhydrocellobiose and thus a linear beta-(1-4)-D-glucan, while hemicelluloses include a variety of compounds, such as xylans, xyloglucans, arabinoxylans, and mannans in complex branched structures with a spectrum of substituents. Although generally polymorphous, cellulose is found in plant tissue primarily as an insoluble crystalline matrix of parallel glucan chains. Hemicelluloses usually hydrogen bond to cellulose, as well as to other hemicelluloses, which help stabilize the cell wall matrix.

Cellulose is generally found, for example, in the stems, leaves, hulls, husks, and cobs of plants or leaves, branches, and wood of trees. The cellulosic-containing material can be, but is not limited to, agricultural residue, herbaceous material (including energy crops), municipal solid waste, pulp and paper mill residue, waste paper, and wood (including forestry residue) (see, for example, Wiselogel et al., 1995, in Handbook on Bioethanol (Charles E. Wyman, editor), pp. 105-118, Taylor & Francis, Washington D.C.; Wyman, 1994, *Bioresource Technology* 50: 3-16; Lynd, 1990, *Applied Biochemistry and Biotechnology* 24/25: 695-719; Mosier et al., 1999, Recent Progress in Bioconversion of Lignocellulosics, in *Advances in Biochemical Engineering/Biotechnology*, T. Scheper, managing editor, Volume 65, pp. 23-40, Springer-Verlag, New York). It is understood herein that the cellulose may be in the form of lignocellulose, a plant cell wall material containing lignin, cellulose, and hemicellulose in a mixed matrix. In one embodiment, the cellulosic-containing material is any biomass material. In another embodiment, the cellulosic-containing material is lignocellulose, which comprises cellulose, hemicelluloses, and lignin.

In one embodiment, the cellulosic-containing material is agricultural residue, herbaceous material (including energy crops), municipal solid waste, pulp and paper mill residue, waste paper, or wood (including forestry residue).

In another embodiment, the cellulosic-containing material is arundo, bagasse, bamboo, corn cob, corn fiber, corn stover, miscanthus, rice straw, switchgrass, or wheat straw.

In another embodiment, the cellulosic-containing material is aspen, eucalyptus, fir, pine, poplar, spruce, or willow.

In another embodiment, the cellulosic-containing material is algal cellulose, bacterial cellulose, cotton linter, filter paper, microcrystalline cellulose (e.g., AVICEL®), or phosphoric-acid treated cellulose.

In another embodiment, the cellulosic-containing material is an aquatic biomass. As used herein the term "aquatic biomass" means biomass produced in an aquatic environment by a photosynthesis process. The aquatic biomass can be algae, emergent plants, floating-leaf plants, or submerged plants.

In another embodiment, the cellulosic-containing material is a whole stillage byproduct from a process for producing a fermentation from a starch-containing material.

The cellulosic-containing material may be used as is or may be subjected to pretreatment, using conventional methods known in the art, as described herein. In a preferred embodiment, the cellulosic-containing material is pretreated.

The methods of using cellulosic-containing material can be accomplished using methods conventional in the art. Moreover, the methods of can be implemented using any conventional biomass processing apparatus configured to carry out the processes.

Cellulosic Pretreatment

In one embodiment the cellulosic-containing material is pretreated before saccharification in step (ii).

In practicing the processes described herein, any pretreatment process known in the art can be used to disrupt plant cell wall components of the cellulosic-containing material (Chandra et al., 2007, *Adv. Biochem. Engin./Biotechnol.* 108: 67-93; Galbe and Zacchi, 2007, *Adv. Biochem. Engin./ Biotechnol.* 108: 41-65; Hendriks and Zeeman, 2009, *Bioresource Technology* 100: 10-18; Mosier et al., 2005, *Bioresource Technology* 96: 673-686; Taherzadeh and Karimi, 2008, *Int. J. Mol. Sci.* 9: 1621-1651; Yang and Wyman, 2008, *Biofuels Bioproducts and Biorefining-Biofpr.* 2: 26-40).

The cellulosic-containing material can also be subjected to particle size reduction, sieving, pre-soaking, wetting, washing, and/or conditioning prior to pretreatment using methods known in the art.

Conventional pretreatments include, but are not limited to, steam pretreatment (with or without explosion), dilute acid pretreatment, hot water pretreatment, alkaline pretreatment, lime pretreatment, wet oxidation, wet explosion, ammonia fiber explosion, organosolv pretreatment, and biological pretreatment. Additional pretreatments include ammonia percolation, ultrasound, electroporation, microwave, supercritical $CO_2$, supercritical $H_2O$, ozone, ionic liquid, and gamma irradiation pretreatments.

In a one embodiment, the cellulosic-containing material is pretreated before saccharification (i.e., hydrolysis) and/or fermentation. Pretreatment is preferably performed prior to the hydrolysis. Alternatively, the pretreatment can be carried out simultaneously with enzyme hydrolysis to release fermentable sugars, such as glucose, xylose, and/or cellobiose. In most cases the pretreatment step itself results in some conversion of biomass to fermentable sugars (even in absence of enzymes).

In one embodiment, the cellulosic-containing material is pretreated with steam. In steam pretreatment, the cellulosic-containing material is heated to disrupt the plant cell wall components, including lignin, hemicellulose, and cellulose to make the cellulose and other fractions, e.g., hemicellulose, accessible to enzymes. The cellulosic-containing material is passed to or through a reaction vessel where steam is injected to increase the temperature to the required temperature and pressure and is retained therein for the desired reaction time. Steam pretreatment is preferably performed at 140-250° C., e.g., 160-200° C. or 170-190° C., where the optimal temperature range depends on optional addition of a chemical catalyst. Residence time for the steam pretreatment is preferably 1-60 minutes, e.g., 1-30 minutes, 1-20 minutes, 3-12 minutes, or 4-10 minutes, where the optimal residence time depends on the temperature and optional addition of a chemical catalyst. Steam pretreatment allows for relatively high solids loadings, so that the cellulosic-containing material is generally only moist during the pretreatment. The steam pretreatment is often combined with an explosive discharge of the material after the pretreatment, which is known as steam explosion, that is, rapid flashing to atmospheric pressure and turbulent flow of the material to increase the accessible surface area by fragmentation (Duff and Murray, 1996, *Bioresource Technology* 855: 1-33; Galbe and Zacchi, 2002, *Appl. Microbiol. Biotechnol.* 59: 618-628; U.S. Patent Application No. 2002/0164730). During steam pretreatment, hemicellulose acetyl groups are cleaved and the resulting acid autocatalyzes partial hydrolysis of the hemicellulose to monosaccharides and oligosaccharides. Lignin is removed to only a limited extent.

In one embodiment, the cellulosic-containing material is subjected to a chemical pretreatment. The term "chemical treatment" refers to any chemical pretreatment that promotes the separation and/or release of cellulose, hemicellulose, and/or lignin. Such a pretreatment can convert crystalline cellulose to amorphous cellulose. Examples of suitable chemical pretreatment processes include, for example, dilute acid pretreatment, lime pretreatment, wet oxidation, ammonia fiber/freeze expansion (AFEX), ammonia percolation (APR), ionic liquid, and organosolv pretreatments.

A chemical catalyst such as $H_2SO_4$ or $SO_2$ (typically 0.3 to 5% w/w) is sometimes added prior to steam pretreatment, which decreases the time and temperature, increases the recovery, and improves enzymatic hydrolysis (Ballesteros et al., 2006, *Appl. Biochem. Biotechnol.* 129-132: 496-508; Varga et al., 2004, *Appl. Biochem. Biotechnol.* 113-116: 509-523; Sassner et al., 2006, *Enzyme Microb. Technol.* 39: 756-762). In dilute acid pretreatment, the cellulosic-containing material is mixed with dilute acid, typically $H_2SO_4$, and water to form a slurry, heated by steam to the desired temperature, and after a residence time flashed to atmospheric pressure. The dilute acid pretreatment can be performed with a number of reactor designs, e.g., plug-flow reactors, counter-current reactors, or continuous counter-current shrinking bed reactors (Duff and Murray, 1996, *Bioresource Technology* 855: 1-33; Schell et al., 2004, *Bioresource Technology* 91: 179-188; Lee et al., 1999, *Adv. Biochem. Eng. Biotechnol.* 65: 93-115). In a specific embodiment the dilute acid pretreatment of cellulosic-containing material is carried out using 4% w/w sulfuric acid at 180° C. for 5 minutes.

Several methods of pretreatment under alkaline conditions can also be used. These alkaline pretreatments include, but are not limited to, sodium hydroxide, lime, wet oxidation, ammonia percolation (APR), and ammonia fiber/freeze expansion (AFEX) pretreatment. Lime pretreatment is performed with calcium oxide or calcium hydroxide at temperatures of 85-150° C. and residence times from one hour to several days (Wyman et al., 2005, *Bioresource Technology* 96: 1959-1966; Mosier et al., 2005, *Bioresource Technology* 96: 673-686). WO 2006/110891, WO 2006/110899, WO 2006/110900, and WO 2006/110901 disclose pretreatment methods using ammonia.

Wet oxidation is a thermal pretreatment performed typically at 180-200° C. for 5-15 minutes with addition of an oxidative agent such as hydrogen peroxide or over-pressure of oxygen (Schmidt and Thomsen, 1998, *Bioresource Technology* 64: 139-151; Palonen et al., 2004, *Appl. Biochem. Biotechnol.* 117: 1-17; Varga et al., 2004, *Biotechnol. Bioeng.* 88: 567-574; Martin et al., 2006, *J. Chem. Technol. Biotechnol.* 81: 1669-1677). The pretreatment is performed preferably at 1-40% dry matter, e.g., 2-30% dry matter or 5-20% dry matter, and often the initial pH is increased by the addition of alkali such as sodium carbonate.

A modification of the wet oxidation pretreatment method, known as wet explosion (combination of wet oxidation and steam explosion) can handle dry matter up to 30%. In wet explosion, the oxidizing agent is introduced during pretreatment after a certain residence time. The pretreatment is then ended by flashing to atmospheric pressure (WO2006/032282).

Ammonia fiber expansion (AFEX) involves treating the cellulosic-containing material with liquid or gaseous ammonia at moderate temperatures such as 90-150° C. and high pressure such as 17-20 bar for 5-10 minutes, where the dry matter content can be as high as 60% (Gollapalli et al., 2002, *Appl. Biochem. Biotechnol.* 98: 23-35; Chundawat et al., 2007, *Biotechnol. Bioeng.* 96: 219-231; Alizadeh et al., 2005, *Appl. Biochem. Biotechnol.* 121: 1133-1141; Teymouri et al., 2005, *Biosoumre Technology* 96: 2014-2018).

During AFEX pretreatment cellulose and hemicelluloses remain relatively intact. Lignin-carbohydrate complexes are cleaved.

Organosolv pretreatment delignifies the cellulosic-containing material by extraction using aqueous ethanol (40-60% ethanol) at 160-200° C. for 30-60 minutes (Pan et al., 2005, *Biotechnol. Bioeng.* 90: 473-481; Pan et al., 2006, *Biotechnol. Bioeng.* 94: 851-861; Kurabi et al., 2005, *Appl. Biochem. Biotechnol.* 121: 219-230). Sulphuric acid is usually added as a catalyst. In organosolv pretreatment, the majority of hemicellulose and lignin is removed.

Other examples of suitable pretreatment methods are described by Schell et al., 2003, *Appl. Biochem. Biotechnol.* 105-108: 69-85, and Mosier et al., 2005, *Bioresource Technology* 96: 673-686, and U.S. Published Application 2002/0164730.

In one embodiment, the chemical pretreatment is carried out as a dilute acid treatment, and more preferably as a continuous dilute acid treatment. The acid is typically sulfuric acid, but other acids can also be used, such as acetic acid, citric acid, nitric acid, phosphoric acid, tartaric acid, succinic acid, hydrogen chloride, or mixtures thereof. Mild acid treatment is conducted in the pH range of preferably 1-5, e.g., 1-4 or 1-2.5. In one aspect, the acid concentration is in the range from preferably 0.01 to 10 wt. % acid, e.g., 0.05 to 5 wt. % acid or 0.1 to 2 wt. % acid. The acid is contacted with the cellulosic-containing material and held at a temperature in the range of preferably 140-200° C., e.g., 165-190° C., for periods ranging from 1 to 60 minutes.

In another embodiment, pretreatment takes place in an aqueous slurry. In preferred aspects, the cellulosic-containing material is present during pretreatment in amounts preferably between 10-80 wt. %, e.g., 20-70 wt. % or 30-60 wt. %, such as around 40 wt. %. The pretreated cellulosic-containing material can be unwashed or washed using any method known in the art, e.g., washed with water.

In one embodiment, the cellulosic-containing material is subjected to mechanical or physical pretreatment. The term "mechanical pretreatment" or "physical pretreatment" refers to any pretreatment that promotes size reduction of particles. For example, such pretreatment can involve various types of grinding or milling (e.g., dry milling, wet milling, or vibratory ball milling).

The cellulosic-containing material can be pretreated both physically (mechanically) and chemically. Mechanical or physical pretreatment can be coupled with steaming/steam explosion, hydrothermolysis, dilute or mild acid treatment, high temperature, high pressure treatment, irradiation (e.g., microwave irradiation), or combinations thereof. In one aspect, high pressure means pressure in the range of preferably about 100 to about 400 psi, e.g., about 150 to about 250 psi. In another aspect, high temperature means temperature in the range of about 100 to about 300° C., e.g., about 140 to about 200° C. In a preferred aspect, mechanical or physical pretreatment is performed in a batch-process using a steam gun hydrolyzer system that uses high pressure and high temperature as defined above, e.g., a Sunds Hydrolyzer available from Sunds Defibrator AB, Sweden. The physical and chemical pretreatments can be carried out sequentially or simultaneously, as desired.

Accordingly, in one embodiment, the cellulosic-containing material is subjected to physical (mechanical) or chemical pretreatment, or any combination thereof, to promote the separation and/or release of cellulose, hemicellulose, and/or lignin.

In one embodiment, the cellulosic-containing material is subjected to a biological pretreatment. The term "biological pretreatment" refers to any biological pretreatment that promotes the separation and/or release of cellulose, hemicellulose, and/or lignin from the cellulosic-containing material. Biological pretreatment techniques can involve applying lignin-solubilizing microorganisms and/or enzymes (see, for example, Hsu, T.-A., 1996, Pretreatment of biomass, in *Handbook on Bioethanol: Production and Utilization*, Wyman, C. E., ed., Taylor & Francis, Washington, DC, 179-212; Ghosh and Singh, 1993, *Adv. Appl. Microbiol.* 39: 295-333; McMillan, J. D., 1994, Pretreating lignocellulosic biomass: a review, in Enzymatic Conversion of Biomass for Fuels Production, Himmel, M. E., Baker, J. O., and Overend, R. P., eds., *ACS Symposium Series* 566, American Chemical Society, Washington, DC, chapter 15; Gong, C. S., Cao, N. J., Du, J., and Tsao, G. T., 1999, Ethanol production from renewable resources, in *Advances in Biochemical Engineering/Biotechnology*, Scheper, T., ed., Springer-Verlag Berlin Heidelberg, Germany, 65: 207-241; Olsson and Hahn-Hagerdal, 1996, *Enz. Microb. Tech.* 18: 312-331; and Vallander and Eriksson, 1990, *Adv. Biochem. Eng./Biotechnol.* 42: 63-95).

Saccharification and Fermentation of Cellulosic-Containing Material

Saccharification (i.e., hydrolysis) and fermentation, separate or simultaneous, include, but are not limited to, separate hydrolysis and fermentation (SHF); simultaneous saccharification and fermentation (SSF); simultaneous saccharification and co-fermentation (SSCF); hybrid hydrolysis and fermentation (HHF); separate hydrolysis and co-fermentation (SHCF); hybrid hydrolysis and co-fermentation (HHCF).

SHF uses separate process steps to first enzymatically hydrolyze the cellulosic-containing material to fermentable sugars, e.g., glucose, cellobiose, and pentose monomers, and then ferment the fermentable sugars to ethanol. In SSF, the enzymatic hydrolysis of the cellulosic-containing material and the fermentation of sugars to ethanol are combined in one step (Philippidis, G. P., 1996, Cellulose bioconversion technology, in *Handbook on Bioethanol: Production and Utilization*, Wyman, C. E., ed., Taylor & Francis, Washington, DC, 179-212). SSCF involves the co-fermentation of multiple sugars (Sheehan and Himmel, 1999, *Biotechnol. Prog.* 15: 817-827). HHF involves a separate hydrolysis step, and in addition a simultaneous saccharification and hydrolysis step, which can be carried out in the same reactor. The steps in an HHF process can be carried out at different temperatures, i.e., high temperature enzymatic saccharification followed by SSF at a lower temperature that the fermentation organism can tolerate. It is understood herein that any method known in the art comprising pretreatment, enzymatic hydrolysis (saccharification), fermentation, or a combination thereof, can be used in the practicing the processes described herein.

A conventional apparatus can include a fed-batch stirred reactor, a batch stirred reactor, a continuous flow stirred reactor with ultrafiltration, and/or a continuous plug-flow column reactor (de Castilhos Corazza et al., 2003, *Acta Scientiarum. Technology* 25: 33-38; Gusakov and Sinitsyn, 1985, *Enz. Microb. Technol.* 7: 346-352), an attrition reactor (Ryu and Lee, 1983, *Biotechnol. Bioeng.* 25: 53-65). Additional reactor types include fluidized bed, upflow blanket, immobilized, and extruder type reactors for hydrolysis and/or fermentation.

In the saccharification step (i.e., hydrolysis step), the cellulosic and/or starch-containing material, e.g., pretreated or liquified, is hydrolyzed to break down cellulose, hemicellulose, and/or starch to fermentable sugars, such as glucose, cellobiose, xylose, xylulose, arabinose, mannose, galactose, and/or soluble oligosaccharides. The hydrolysis is performed enzymatically e.g., by a cellulolytic enzyme composition. The enzymes of the compositions can be added simultaneously or sequentially.

Enzymatic hydrolysis may be carried out in a suitable aqueous environment under conditions that can be readily determined by one skilled in the art. In one aspect, hydrolysis is performed under conditions suitable for the activity of the enzymes(s), i.e., optimal for the enzyme(s). The hydrolysis can be carried out as a fed batch or continuous process where the cellulosic and/or starch-containing material is fed gradually to, for example, an enzyme containing hydrolysis solution.

The saccharification is generally performed in stirred-tank reactors or fermentors under controlled pH, temperature, and mixing conditions. Suitable process time, temperature and pH conditions can readily be determined by one skilled in the art. For example, the saccharification can last up to 200 hours, but is typically performed for preferably about 12 to about 120 hours, e.g., about 16 to about 72 hours or about 24 to about 48 hours. The temperature is in the range of preferably about 25° C. to about 70° C., e.g., about 30° C. to about 65° C., about 40° C. to about 60° C., or about 50° C. to about 55° C. The pH is in the range of preferably about 3 to about 8, e.g., about 3.5 to about 7, about 4 to about 6, or about 4.5 to about 5.5. The dry solids content is in the range of preferably about 5 to about 50 wt. %, e.g., about 10 to about 40 wt. % or about 20 to about 30 wt. %.

Saccharification in step (ii) may be carried out using a cellulolytic enzyme composition. Such enzyme compositions are described below in the "Cellulolytic Enzyme Composition'-section below. The cellulolytic enzyme compositions can comprise any protein useful in degrading the cellulosic-containing material. In one aspect, the cellulolytic enzyme composition comprises or further comprises one or more (e.g., two, several) proteins selected from the group consisting of a cellulase, an AA9 (GH61) polypeptide, a hemicellulase, an esterase, an expansin, a ligninolytic enzyme, an oxidoreductase, a pectinase, a protease, and a swollenin.

In another embodiment, the cellulase is preferably one or more (e.g., two, several) enzymes selected from the group consisting of an endoglucanase, a cellobiohydrolase, and a beta-glucosidase.

In another embodiment, the hemicellulase is preferably one or more (e.g., two, several) enzymes selected from the group consisting of an acetylmannan esterase, an acetylxylan esterase, an arabinanase, an arabinofuranosidase, a coumaric acid esterase, a feruloyl esterase, a galactosidase, a glucuronidase, a glucuronoyl esterase, a mannanase, a mannosidase, a xylanase, and a xylosidase. In another embodiment, the oxidoreductase is one or more (e.g., two, several) enzymes selected from the group consisting of a catalase, a laccase, and a peroxidase.

The enzymes or enzyme compositions used in a processes of the present invention may be in any form suitable for use, such as, for example, a fermentation broth formulation or a cell composition, a cell lysate with or without cellular debris, a semi-purified or purified enzyme preparation, or a host cell as a source of the enzymes. The enzyme composition may be a dry powder or granulate, a non-dusting granulate, a liquid, a stabilized liquid, or a stabilized protected enzyme. Liquid enzyme preparations may, for instance, be stabilized by adding stabilizers such as a sugar, a sugar alcohol or another polyol, and/or lactic acid or another organic acid according to established processes.

In one embodiment, an effective amount of cellulolytic or hemicellulolytic enzyme composition to the cellulosic-containing material is about 0.5 to about 50 mg, e.g., about 0.5 to about 40 mg, about 0.5 to about 25 mg, about 0.75 to about 20 mg, about 0.75 to about 15 mg, about 0.5 to about 10 mg, or about 2.5 to about 10 mg per g of the cellulosic-containing material.

In one embodiment, such a compound is added at a molar ratio of the compound to glucosyl units of cellulose of about $10^{-6}$ to about 10, e.g., about $10^{-6}$ to about 7.5, about $10^{-6}$ to about 5, about $10^{-6}$ to about 2.5, about $10^{-6}$ to about 1, about $10^{-5}$ to about 1, about $10^{-5}$ to about $10^{-1}$, about $10^{-4}$ to about $10^{-1}$, about $10^{-3}$ to about $10^{-1}$, or about $10^{-3}$ to about $10^{-2}$.

In another aspect, an effective amount of such a compound is about 0.1 µM to about 1 M, e.g., about 0.5 µM to about 0.75 M, about 0.75 µM to about 0.5 M, about 1 µM to about 0.25 M, about 1 µM to about 0.1 M, about 5 µM to about 50 mM, about 10 µM to about 25 mM, about 50 µM to about 25 mM, about 10 µM to about 10 mM, about 5 µM to about 5 mM, or about 0.1 mM to about 1 mM.

The term "liquor" means the solution phase, either aqueous, organic, or a combination thereof, arising from treatment of a lignocellulose and/or hemicellulose material in a slurry, or monosaccharides thereof, e.g., xylose, arabinose, mannose, etc., under conditions as described in WO 2012/021401, and the soluble contents thereof. A liquor for cellulolytic enhancement of an AA9 polypeptide (GH61 polypeptide) can be produced by treating a lignocellulose or hemicellulose material (or feedstock) by applying heat and/or pressure, optionally in the presence of a catalyst, e.g., acid, optionally in the presence of an organic solvent, and optionally in combination with physical disruption of the material, and then separating the solution from the residual solids. Such conditions determine the degree of cellulolytic enhancement obtainable through the combination of liquor and an AA9 polypeptide during hydrolysis of a cellulosic substrate by a cellulolytic enzyme preparation. The liquor can be separated from the treated material using a method standard in the art, such as filtration, sedimentation, or centrifugation.

In one embodiment, an effective amount of the liquor to cellulose is about $10^{-6}$ to about 10 g per g of cellulose, e.g., about $10^{-6}$ to about 7.5 g, about $10^{-6}$ to about 5 g, about $10^{-6}$ to about 2.5 g, about $10^{-6}$ to about 1 g, about $10^{-5}$ to about 1 g, about $10^{-5}$ to about $10^{-1}$ g, about $10^{-4}$ to about $10^{-1}$ g, about $10^{-3}$ to about $10^{-1}$ g, or about $10^{-3}$ to about $10^{-2}$ g per g of cellulose.

In the fermentation step, sugars, released from the cellulosic-containing material, e.g., as a result of the pretreatment and enzymatic hydrolysis steps, are fermented to ethanol, by a fermenting organism, such as yeast described herein. Hydrolysis (saccharification) and fermentation can be separate or simultaneous.

Any suitable hydrolyzed cellulosic-containing material can be used in the fermentation step in practicing the processes described herein. Such feedstocks include, but are not limited to carbohydrates (e.g., lignocellulose, xylans, cellulose, starch, etc.). The material is generally selected based on economics, i.e., costs per equivalent sugar potential, and recalcitrance to enzymatic conversion.

Production of ethanol by a fermenting organism using cellulosic-containing material results from the metabolism of sugars (monosaccharides). The sugar composition of the hydrolyzed cellulosic-containing material and the ability of the fermenting organism to utilize the different sugars has a direct impact in process yields.

Compositions of the fermentation media and fermentation conditions depend on the fermenting organism and can easily be determined by one skilled in the art. Typically, the fermentation takes place under conditions known to be suitable for generating the fermentation product. In some embodiments, the fermentation process is carried out under aerobic or microaerophilic (i.e., where the concentration of oxygen is less than that in air), or anaerobic conditions. In some embodiments, fermentation is conducted under anaerobic conditions (i.e., no detectable oxygen), or less than about 5, about 2.5, or about 1 mmol/L/h oxygen. In the absence of oxygen, the NADH produced in glycolysis cannot be oxidized by oxidative phosphorylation. Under anaerobic conditions, pyruvate or a derivative thereof may be utilized by the host cell as an electron and hydrogen acceptor in order to generate NAD+.

The fermentation process is typically run at a temperature that is optimal for the recombinant fungal cell. For example, in some embodiments, the fermentation process is performed at a temperature in the range of from about 25° C. to about 42° C. Typically the process is carried out a temperature that is less than about 38° C., less than about 35° C., less than about 33° C., or less than about 38° C., but at least about 20° C., 22° C., or 25° C.

A fermentation stimulator can be used in a process described herein to further improve the fermentation, and in particular, the performance of the fermenting organism, such as, rate enhancement and product yield (e.g., ethanol yield). A "fermentation stimulator" refers to stimulators for growth of the fermenting organisms, in particular, yeast. Preferred fermentation stimulators for growth include vitamins and minerals. Examples of vitamins include multivitamins, biotin, pantothenate, nicotinic acid, meso-inositol, thiamine, pyridoxine, para-aminobenzoic acid, folic acid, riboflavin, and Vitamins A, B, C, D, and E. See, for example, Alfenore et al., Improving ethanol production and viability of *Saccharomyces cerevisiae* by a vitamin feeding strategy during fed-batch process, Springer-Verlag (2002), which is hereby incorporated by reference. Examples of minerals include minerals and mineral salts that can supply nutrients comprising P, K, Mg, S, Ca, Fe, Zn, Mn, and Cu.

Fermentation Medium

"Fermentation media" or "fermentation medium" refers to the environment in which fermentation is carried out. The fermentation medium includes the fermentation substrate, that is, the carbohydrate source that is metabolized by the fermenting organism. According to the invention the fermentation medium may comprise nutrients and growth stimulator(s) for the fermenting organism(s). Nutrient and growth stimulators are widely used in the art of fermentation and include nitrogen sources, such as ammonia; urea, vitamins and minerals, or combinations thereof.

Fermenting Organisms

The term "Fermenting organism" refers to any organism, including bacterial and fungal organisms, especially yeast, suitable for use in a fermentation process and capable of producing the desired fermentation product. Especially suitable fermenting organisms are able to ferment, i.e., convert, sugars, such as glucose or maltose, directly or indirectly into the desired fermentation product, such as ethanol. Examples of fermenting organisms include fungal organisms, such as yeast. Preferred yeast includes strains of *Saccharomyces* spp., in particular, *Saccharomyces cerevisiae*.

Suitable concentrations of the viable fermenting organism during fermentation, such as SSF, are well known in the art or can easily be determined by the skilled person in the art. In one embodiment the fermenting organism, such as etha-nol fermenting yeast, (e.g., *Saccharomyces cerevisiae*) is added to the fermentation medium so that the viable fermenting organism, such as yeast, count per mL of fermentation medium is in the range from $10^5$ to $10^{12}$, preferably from $10^7$ to $10^{10}$, especially about $5\times10^7$.

Examples of commercially available yeast includes, e.g., RED STAR™ and ETHANOL RED™ yeast (available from Fermentis/Lesaffre, USA), FALI (available from Fleischmann's Yeast, USA), SUPERSTART and THERMO-SACC™ fresh yeast (available from Ethanol Technology, WI, USA), BIOFERM AFT and XR (available from NABC—North American Bioproducts Corporation, GA, USA), GERT STRAND (available from Gert Strand AB, Sweden), and FERMIOL (available from DSM Specialties). Other useful yeast strains are available from biological depositories such as the American Type Culture Collection (ATCC) or the Deutsche Sammlung von Mikroorganismen und Zellkulturen GmbH (DSMZ), such as, e.g., BY4741 (e.g., ATCC 201388); Y108-1 (ATCC PTA.10567) and NRRL YB-1952 (ARS Culture Collection). Still other *S. cerevisiae* strains suitable as host cells DBY746, [Alpha][Eta]22, S150-2B, GPY55-15Ba, CEN.PK, USM21, TMB3500, TMB3400, VTT-A-63015, VTT-A-85068, VTT-c-79093 and their derivatives as well as *Saccharomyces* sp. 1400, 424A (LNH-ST), 259A (LNH-ST) and derivatives thereof.

As used herein, a "derivative" of strain is derived from a referenced strain, such as through mutagenesis, recombinant DNA technology, mating, cell fusion, or cytoduction between yeast strains. Those skilled in the art will understand that the genetic alterations, including metabolic modifications exemplified herein, may be described with reference to a suitable host organism and their corresponding metabolic reactions or a suitable source organism for desired genetic material such as genes for a desired metabolic pathway. However, given the complete genome sequencing of a wide variety of organisms and the high level of skill in the area of genomics, those skilled in the art can apply the teachings and guidance provided herein to other organisms. For example, the metabolic alterations exemplified herein can readily be applied to other species by incorporating the same or analogous encoding nucleic acid from species other than the referenced species.

The host cell or fermenting organism may be *Saccharomyces* strain, e.g., *Saccharomyces cerevisiae* strain produced using the method described and concerned in U.S. Pat. No. 8,257,959-BB. In one embodiment, the recombinant cell is a derivative of a strain *Saccharomyces cerevisiae* CIBTS1260 (deposited under Accession No. NRRL Y-50973 at the *Agricultural Research* Service Culture Collection (NRRL), Illinois 61604 U.S.A.).

The strain may also be a derivative of *Saccharomyces cerevisiae* strain NMI V14/004037 (See, WO2015/143324 and WO2015/143317 each incorporated herein by reference), strain nos. V15/004035, V15/004036, and V15/004037 (See, WO2016/153924 incorporated herein by reference), strain nos. V15/001459, V15/001460, V15/001461 (See, WO2016/138437 incorporated herein by reference), strain no. NRRL Y67342 (See, WO2018/098381 incorporated herein by reference), strain nos. NRRL Y67549 and NRRL Y67700 (See, PCT/US2019/018249 incorporated herein by reference), or any strain described in WO2017/087330 (incorporated herein by reference).

The fermenting organisms may be a host cell that expresses a heterologous beta-glucanase (e.g., any beta-glucanase described herein). Any beta-glucanase contemplated for a process, method, enzyme blend, or composition described herein is also contemplated for expression by a fermenting organism or host cell.

In one embodiment is a recombinant host cell (e.g., yeast host cell, such as a strain of *Saccharomyces*, for example *Saccharomyces cerevisiae*) comprising a heterologous polynucleotide encoding a polypeptide having beta-glucanase activity (e.g., beta-glucanase) (e.g., any beta-glucanase described herein).

In one embodiment is a recombinant yeast host cell comprising a heterologous polynucleotide encoding a polypeptide having beta-1,6-glucanase activity, wherein the polynucleotide comprises, consists, or consists essentially of the nucleotide sequence of SEQ ID NO: 1, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 1, which has beta-1,6-glucanase activity.

In one embodiment is a recombinant yeast host cell comprising a heterologous polynucleotide encoding a polypeptide having beta-1,6-glucanase activity, wherein the polypeptide comprises, consists of, or consists essentially of the mature polypeptide of SEQ ID NO: 2, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 2, which has beta-1,6-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 4, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 4, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 5, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 5, which has beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 7, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 7, which has beta-1,3-glucanase activity. In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 8, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 8, which has beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 10, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 10, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 11, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 11, which has beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 16, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 16, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 17, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at 60 least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 17, which has beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 19, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 19, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 20, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 20, which has beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 22, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 22, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 23, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 23, which has beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 31, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 31, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 32, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 32, which has beta-1,3-glucanase activity.

In one embodiment is a recombinant yeast host cell comprising a heterologous polynucleotide encoding a polypeptide having beta-1,6-glucanase activity, wherein the polynucleotide comprises, consists, or consists essentially of the nucleotide sequence of SEQ ID NO: 34, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 34, which has beta-1,6-glucanase activity.

In one embodiment is a recombinant yeast host cell comprising a heterologous polynucleotide encoding a polypeptide having beta-1,6-glucanase activity, wherein the polypeptide comprises, consists of, or consists essentially of the mature polypeptide of SEQ ID NO: 35, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 35, which has beta-1,6-glucanase activity.

In one embodiment is a recombinant yeast host cell comprising a heterologous polynucleotide encoding a polypeptide having beta-1,6-glucanase activity, wherein the polynucleotide comprises, consists, or consists essentially of the nucleotide sequence of SEQ ID NO: 37, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 37, which has beta-1,6-glucanase activity.

In one embodiment is a recombinant yeast host cell comprising a heterologous polynucleotide encoding a polypeptide having beta-1,6-glucanase activity, wherein the polypeptide comprises, consists of, or consists essentially of the mature polypeptide of SEQ ID NO: 38, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 38, which has beta-1,6-glucanase activity.

In one embodiment is a recombinant yeast host cell comprising a heterologous polynucleotide encoding a polypeptide having beta-1,6-glucanase activity, wherein the polynucleotide comprises, consists, or consists essentially of the nucleotide sequence of SEQ ID NO: 40, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 40, which has beta-1,6-glucanase activity.

In one embodiment is a recombinant yeast host cell comprising a heterologous polynucleotide encoding a polypeptide having beta-1,6-glucanase activity, wherein the polypeptide comprises, consists of, or consists essentially of the mature polypeptide of SEQ ID NO: 41, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 41, which has beta-1,6-glucanase activity.

In one embodiment is a recombinant yeast host cell comprising a heterologous polynucleotide encoding a polypeptide having beta-1,6-glucanase activity and/or beta-1,3-glucanase activity, wherein the polynucleotide comprises, consists, or consists essentially of the nucleotide sequence of SEQ ID NO: 55, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 55, which has beta-1,6-glucanase activity and/or beta-1,3-glucanase activity.

In one embodiment is a recombinant yeast host cell comprising a heterologous polynucleotide encoding a polypeptide having beta-1,6-glucanase activity and/or beta-1,3-glucanase activity, wherein the polypeptide comprises, consists of, or consists essentially of the mature polypeptide of SEQ ID NO: 56, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 56, which has beta-1,6-glucanase activity and/or beta-1,3-glucanase activity.

In one embodiment is a recombinant yeast host cell comprising a heterologous polynucleotide encoding a polypeptide having beta-1,6-glucanase activity and/or beta-1,3-glucanase activity, wherein the polynucleotide comprises, consists, or consists essentially of the nucleotide sequence of SEQ ID NO: 58, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 58, which has beta-1,6-glucanase activity and/or beta-1,3-glucanase activity.

In one embodiment is a recombinant yeast host cell comprising a heterologous polynucleotide encoding a polypeptide having beta-1,6-glucanase activity and/or beta-1,3-glucanase activity, wherein the polypeptide comprises, consists of, or consists essentially of the mature polypeptide of SEQ ID NO: 59, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 59, which has beta-1,6-glucanase activity and/or beta-1,3-glucanase activity.

In one embodiment is a recombinant yeast host cell comprising a heterologous polynucleotide encoding a polypeptide having beta-1,6-glucanase activity and/or beta-1,3-glucanase activity, wherein the polynucleotide comprises, consists, or consists essentially of the nucleotide sequence of SEQ ID NO: 61, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 61, which has beta-1,6-glucanase activity and/or beta-1,3-glucanase activity.

In one embodiment is a recombinant yeast host cell comprising a heterologous polynucleotide encoding a polypeptide having beta-1,6-glucanase activity and/or beta-1,3-glucanase activity, wherein the polypeptide comprises, consists of, or consists essentially of the mature polypeptide of SEQ ID NO: 62, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 62, which has beta-1,6-glucanase activity and/or beta-1,3-glucanase activity.

In one embodiment is a recombinant yeast host cell comprising a heterologous polynucleotide encoding a polypeptide having beta-1,6-glucanase activity and/or beta-1,3-glucanase activity, wherein the polynucleotide comprises, consists, or consists essentially of the nucleotide sequence of SEQ ID NO: 67, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 67, which has beta-1,6-glucanase activity and/or beta-1,3-glucanase activity.

In one embodiment is a recombinant yeast host cell comprising a heterologous polynucleotide encoding a polypeptide having beta-1,6-glucanase activity and/or beta-1,3-glucanase activity, wherein the polypeptide comprises, consists of, or consists essentially of the mature polypeptide of SEQ ID NO: 68, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 68, which has beta-1,6-glucanase activity and/or beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 106, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 106, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 107, which has beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 109, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 109, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 110, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 110, which has beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 112, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 112, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 113, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 113, which has beta-1,3-glucanase activity.

In one embodiment is a recombinant yeast host cell comprising a heterologous polynucleotide encoding a polypeptide having beta-1,3-glucanase activity, wherein the polynucleotide comprises, consists, or consists essentially of the nucleotide sequence of SEQ ID NO: 115, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 115, which has beta-1,3-glucanase activity.

In one embodiment is a recombinant yeast host cell comprising a heterologous polynucleotide encoding a polypeptide having beta-1,3-glucanase activity, wherein the polypeptide comprises, consists of, or consists essentially of the mature polypeptide of SEQ ID NO: 116, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 116, which has beta-1,3-glucanase activity.

In one embodiment is a recombinant yeast host cell comprising a heterologous polynucleotide encoding a polypeptide having beta-1,6-glucanase activity, wherein the polynucleotide comprises, consists, or consists essentially of the nucleotide sequence of SEQ ID NO: 118, or is a polynucleotide comprising, consisting of, or consisting essentially of a nucleotide sequence having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide coding sequence of SEQ ID NO: 118, which has beta-1,6-glucanase activity.

In one embodiment is a recombinant yeast host cell comprising a heterologous polynucleotide encoding a polypeptide having beta-1,6-glucanase activity, wherein the polypeptide comprises, consists of, or consists essentially of the mature polypeptide of SEQ ID NO: 119, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 119, which has beta-1,6-glucanase activity.

The fermenting organisms may be a host cell that expresses heterologous polynucleotides encoding enzymes other than the beta-glucanases of the present invention, or that expresses such enzymes in addition to the beta-glucanases of the present invention.

In some embodiments, the host cells and/or fermenting organisms comprise one or more heterologous polynucleotides encoding an alpha-amylase, glucoamylase, protease and/or cellulase. Examples of alpha-amylase, glucoamylase, protease and cellulases suitable for expression in the host cells and/or fermenting organisms are described in more detail herein.

Thus, the present invention contemplates compositions (e.g., fermenting mash compositions) which comprise a recombinant host cell and/or fermenting organism comprising: (i) one or more heterologous polynucleotides encoding an alpha-amylase, glucoamylase, protease, and/or cellulase, and (ii) at least one beta-glucanase of the present invention.

The host cells and fermenting organisms described herein may utilize expression vectors comprising the coding sequence of one or more (e.g., two, several) heterologous genes linked to one or more control sequences that direct expression in a suitable cell under conditions compatible with the control sequence(s). Such expression vectors may be used in any of the cells and methods described herein. The polynucleotides described herein may be manipulated in a variety of ways to provide for expression of a desired polypeptide. Manipulation of the polynucleotide prior to its insertion into a vector may be desirable or necessary depending on the expression vector. The techniques for modifying polynucleotides utilizing recombinant DNA methods are well known in the art.

A construct or vector (or multiple constructs or vectors) comprising the one or more (e.g., two, several) heterologous genes may be introduced into a cell so that the construct or vector is maintained as a chromosomal integrant or as a self-replicating extra-chromosomal vector as described earlier.

The various nucleotide and control sequences may be joined together to produce a recombinant expression vector that may include one or more (e.g., two, several) convenient restriction sites to allow for insertion or substitution of the polynucleotide at such sites. Alternatively, the polynucleotide(s) may be expressed by inserting the polynucleotide(s) or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the cell, or a transposon, may be used.

The expression vector may contain any suitable promoter sequence that is recognized by a cell for expression of a gene described herein. The promoter sequence contains transcriptional control sequences that mediate the expression of the polypeptide. The promoter may be any polynucleotide that shows transcriptional activity in the cell of choice including mutant, truncated, and hybrid promoters, and may be obtained from genes encoding extracellular or intracellular polypeptides either homologous or heterologous to the cell.

Each heterologous polynucleotide described herein may be operably linked to a promoter that is foreign to the polynucleotide. For example, in one embodiment, the nucleic acid construct encoding the fusion protein is operably linked to a promoter foreign to the polynucleotide. The promoters may be identical to or share a high degree of sequence identity (e.g., at least about 80%, at least about 85%, at least about 90%, at least about 95%, at least about 96%, at least about 97%, at least about 98%, or at least about 99%) with a selected native promoter.

Examples of suitable promoters for directing the transcription of the nucleic acid constructs in a yeast cells, include, but are not limited to, the promoters obtained from the genes for enolase, (e.g., *S. cerevisiae* enolase or *I. orientalis* enolase (ENO1)), galactokinase (e.g., *S. cerevisiae* galactokinase or *I. orientalis* galactokinase (GAL1)), alcohol dehydrogenase/glyceraldehyde-3-phosphate dehydrogenase (e.g., *S. cerevisiae* alcohol dehydrogenase/glyceraldehyde-3-phosphate dehydrogenase or *I. orientalis* alcohol dehydrogenase/glyceraldehyde-3-phosphate dehydrogenase (ADH1, ADH2/GAP)), triose phosphate isomerase (e.g., *S. cerevisiae* triose phosphate isomerase or *I. orientalis* triose phosphate isomerase (TPI)), metallothionein (e.g., *S. cerevisiae* metallothionein or *I. orientalis* metallothionein (CUP1)), 3-phosphoglycerate kinase (e.g., *S. cerevisiae* 3-phosphoglycerate kinase or *I. orientalis* 3-phosphoglycerate kinase (PGK)), PDC1, xylose reductase (XR), xylitol dehydrogenase (XDH), L-(+)-lactate-cytochrome c oxidoreductase (CYB2), translation elongation factor-1 (TEF1), translation elongation factor-2 (TEF2), glyceraldehyde-3-phosphate dehydrogenase (GAPDH), and orotidine 5'-phosphate decarboxylase (URA3) genes. Other suitable promoters may be obtained from *S. cerevisiae* TDH3, HXT7, PGK1, RPL18B and CCW12 genes. Additional useful promoters for yeast host cells are described by Romanos et al., 1992, *Yeast* 8: 423-488.

The control sequence may also be a suitable transcription terminator sequence, which is recognized by a host cell to terminate transcription. The terminator sequence is operably linked to the 3'-terminus of the polynucleotide encoding the polypeptide. Any terminator that is functional in the yeast cell of choice may be used. The terminator may be identical to or share a high degree of sequence identity (e.g., at least about 80%, at least about 85%, at least about 90%, at least about 95%, at least about 96%, at least about 97%, at least about 98%, or at least about 99%) with the selected native terminator.

Suitable terminators for yeast host cells may be obtained from the genes for enolase (e.g., *S. cerevisiae* or *I. orientalis* enolase cytochrome C (e.g., *S. cerevisiae* or *I. orientalis* cytochrome (CYC1)), glyceraldehyde-3-phosphate dehydrogenase (e.g., *S. cerevisiae* or *L. orientalis* glyceraldehyde-3-phosphate dehydrogenase (gpd)), PDC1, XR, XDH, transaldolase (TAL), transketolase (TKL), ribose 5-phosphate ketol-isomerase (RKI), CYB2, and the galactose family of genes (especially the GAL10 terminator). Other suitable terminators may be obtained from *S. cerevisiae* ENO2 or TEF1 genes. Additional useful terminators for yeast host cells are described by Romanos et al., 1992, supra.

The control sequence may also be an mRNA stabilizer region downstream of a promoter and upstream of the coding sequence of a gene which increases expression of the gene.

Examples of suitable mRNA stabilizer regions are obtained from a *Bacillus thuringiensis* cryIIIA gene (WO 94/25612) and a *Bacillus subtilis* SP82 gene (Hue et al., 1995, *Journal of Bacteriology* 177: 3465-3471).

The control sequence may also be a suitable leader sequence, when transcribed is a non-translated region of an mRNA that is important for translation by the host cell. The leader sequence is operably linked to the 5'-terminus of the polynucleotide encoding the polypeptide. Any leader sequence that is functional in the yeast cell of choice may be used.

Suitable leaders for yeast host cells are obtained from the genes for enolase (e.g., *S. cerevisiae* or *L. orientalis* enolase (ENO-1)), 3-phosphoglycerate kinase (e.g., *S. cerevisiae* or

*L. orientalis* 3-phosphoglycerate kinase), alpha-factor (e.g., *S. cerevisiae* or *L. orientalis* alpha-factor), and alcohol dehydrogenase/glyceraldehyde-3-phosphate dehydrogenase (e.g., *S. cerevisiae* or *L. orientalis* alcohol dehydrogenase/glyceraldehyde-3-phosphate dehydrogenase (ADH2/GAP)).

The control sequence may also be a polyadenylation sequence; a sequence operably linked to the 3'-terminus of the polynucleotide and, when transcribed, is recognized by the host cell as a signal to add polyadenosine residues to transcribed mRNA. Any polyadenylation sequence that is functional in the host cell of choice may be used. Useful polyadenylation sequences for yeast cells are described by Guo and Sherman, 1995, *Mol. Cellular Biol.* 15: 5983-5990.

The control sequence may also be a signal peptide coding region that encodes a signal peptide linked to the N-terminus of a polypeptide and directs the polypeptide into the cell's secretory pathway. The 5'-end of the coding sequence of the polynucleotide may inherently contain a signal peptide coding sequence naturally linked in translation reading frame with the segment of the coding sequence that encodes the polypeptide. Alternatively, the 5'-end of the coding sequence may contain a signal peptide coding sequence that is foreign to the coding sequence. A foreign signal peptide coding sequence may be required where the coding sequence does not naturally contain a signal peptide coding sequence. Alternatively, a foreign signal peptide coding sequence may simply replace the natural signal peptide coding sequence in order to enhance secretion of the polypeptide. However, any signal peptide coding sequence that directs the expressed polypeptide into the secretory pathway of a host cell may be used. Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra.

The control sequence may also be a propeptide coding sequence that encodes a propeptide positioned at the N-terminus of a polypeptide. The resultant polypeptide is known as a proenzyme or propolypeptide (or a zymogen in some cases). A propolypeptide is generally inactive and can be converted to an active polypeptide by catalytic or autocatalytic cleavage of the propeptide from the propolypeptide. The propeptide coding sequence may be obtained from the genes for *Bacillus subtilis* alkaline protease (aprE), *Bacillus subtilis* neutral protease (nprT), *Myceliophthora thermophila* laccase (WV 95/33836), *Rhizomucor miehei* aspartic proteinase, and *Saccharomyces cerevisiae* alpha-factor.

Where both signal peptide and propeptide sequences are present, the propeptide sequence is positioned next to the N-terminus of a polypeptide and the signal peptide sequence is positioned next to the N-terminus of the propeptide sequence.

It may also be desirable to add regulatory sequences that allow the regulation of the expression of the polypeptide relative to the growth of the host cell. Examples of regulatory systems are those that cause the expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used.

The vectors may contain one or more (e.g., two, several) selectable markers that permit easy selection of transformed, transfected, transduced, or the like cells. A selectable marker is a gene the product of which provides for biocide or viral resistance, resistance to heavy metals, prototrophy to auxotrophs, and the like. Suitable markers for yeast host cells include, but are not limited to, ADE2, HIS3, LEU2, LYS2, MET3, TRP1, and URA3.

The vectors may contain one or more (e.g., two, several) elements that permit integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination. Potential integration loci include those described in the art (e.g., See US2012/0135481).

For autonomous replication, the vector may further comprise an origin of replication enabling the vector to replicate autonomously in the yeast cell. The origin of replication may be any plasmid replicator mediating autonomous replication that functions in a cell. The term "origin of replication" or "plasmid replicator" means a polynucleotide that enables a plasmid or vector to replicate in vivo. Examples of origins of replication for use in a yeast host cell are the 2 micron origin of replication, ARS1, ARS4, the combination of ARS1 and CEN3, and the combination of ARS4 and CEN6.

More than one copy of a polynucleotide described herein may be inserted into a host cell to increase production of a polypeptide. An increase in the copy number of the polynucleotide can be obtained by integrating at least one additional copy of the sequence into the yeast cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors described herein are well known to one skilled in the art (see, e.g., Sambrook et al., 1989, Molecular Cloning, *A Laboratory Manual*, 2d edition, Cold Spring Harbor, New York).

Additional procedures and techniques known in the art for the preparation of recombinant cells for ethanol fermentation, are described in, e.g., WO 2016/045569, the content of which is hereby incorporated by reference.

The host cell or fermenting organism may be in the form of a composition comprising a host cell or fermenting organism (e.g., a yeast strain described herein) and a naturally occurring and/or a non-naturally occurring component.

The host cell or fermenting organism described herein may be in any viable form, including crumbled, dry, including active dry and instant, compressed, cream (liquid) form etc. In one embodiment, the host cell or fermenting organism (e.g., a *Saccharomyces cerevisiae* yeast strain) is dry yeast, such as active dry yeast or instant yeast. In one embodiment, the host cell or fermenting organism (e.g., a *Saccharomyces cerevisiae* yeast strain) is crumbled yeast. In one embodiment, the host cell or fermenting organism (e.g., a *Saccharomyces cerevisiae* yeast strain) is compressed yeast. In one embodiment, the host cell or fermenting organism (e.g., a *Saccharomyces cerevisiae* yeast strain) is cream yeast.

In one embodiment is a composition comprising a host cell or fermenting organism described herein (e.g., a *Saccharomyces cerevisiae* yeast strain), and one or more of the component selected from the group consisting of surfactants, emulsifiers, gums, swelling agent, and antioxidants and other processing aids.

The compositions described herein may comprise a host cell or fermenting organism described herein (e.g., a *Saccharomyces cerevisiae* yeast strain) and any suitable surfactants. In one embodiment, the surfactant(s) is/are an anionic surfactant, cationic surfactant, and/or nonionic surfactant.

The compositions described herein may comprise a host cell or fermenting organism described herein (e.g., a *Saccharomyces cerevisiae* yeast strain) and any suitable emulsifier. In one embodiment, the emulsifier is a fatty-acid ester of sorbitan. In one embodiment, the emulsifier is selected from the group of sorbitan monostearate (SMS), citric acid esters of monodiglycerides, polyglycerolester, fatty acid esters of propylene glycol.

In one embodiment, the composition comprises a host cell or fermenting organism described herein (e.g., a *Saccharomyces cerevisiae* yeast strain), and Olindronal SMS, Olindronal SK, or Olindronal SPL including composition concerned in European Patent No. 1,724,336 (hereby incorporated by reference). These products are commercially available from Bussetti, Austria, for active dry yeast.

The compositions described herein may comprise a host cell or fermenting organism described herein (e.g., a *Saccharomyces cerevisiae* yeast strain) and any suitable gum. In one embodiment, the gum is selected from the group of carob, guar, tragacanth, arabic, xanthan and acacia gum, in particular for cream, compressed and dry yeast.

The compositions described herein may comprise a host cell or fermenting organism described herein (e.g., a *Saccharomyces cerevisiae* yeast strain) and any suitable swelling agent. In one embodiment, the swelling agent is methyl cellulose or carboxymethyl cellulose.

The compositions described herein may comprise a host cell or fermenting organism described herein (e.g., a *Saccharomyces cerevisiae* yeast strain) and any suitable antioxidant. In one embodiment, the antioxidant is butylated hydroxyanisol (BHA) and/or butylated hydroxytoluene (BHT), or ascorbic acid (vitamin C), particular for active dry yeast.

The compositions described herein may comprise a host cell or fermenting organism described herein (e.g., a *Saccharomyces* yeast strain) and any suitable fermentation enzyme (e.g., alpha-amylase (e.g., a fungal alpha-amylase), glucoamylase, protease, and/or cellulase.

The compositions described herein may comprise a host cell or fermenting organism described herein (e.g., a *Saccharomyces* yeast strain) and at least one beta-glucanase of the present invention.

The compositions described herein may comprise a host cell or fermenting organism described herein (e.g., a *Saccharomyces* yeast strain), at least one beta-glucanase of the present invention, and any suitable fermentation enzyme (e.g., alpha-amylase (e.g., a fungal alpha-amylase), glucoamylase, protease, and/or cellulase).

The host cells and fermenting organisms described herein may also comprise one or more (e.g., two, several) gene disruptions, e.g., to divert sugar metabolism from undesired products to ethanol. In some embodiments, the recombinant host cells produce a greater amount of ethanol compared to the cell without the one or more disruptions when cultivated under identical conditions. In some embodiments, one or more of the disrupted endogenous genes is inactivated.

In certain embodiments, the host cell or fermenting organism provided herein comprises a disruption of one or more endogenous genes encoding enzymes involved in producing alternate fermentative products such as glycerol or other byproducts such as acetate or diols. For example, the cells provided herein may comprise a disruption of one or more of glycerol 3-phosphate dehydrogenase (GPD, catalyzes reaction of dihydroxyacetone phosphate to glycerol 3-phosphate), glycerol 3-phosphatase (GPP, catalyzes conversion of glycerol-3 phosphate to glycerol), glycerol kinase (catalyzes conversion of glycerol 3-phosphate to glycerol), dihydroxyacetone kinase (catalyzes conversion of dihydroxyacetone phosphate to dihydroxyacetone), glycerol dehydrogenase (catalyzes conversion of dihydroxyacetone to glycerol), and aldehyde dehydrogenase (ALD, e.g., converts acetaldehyde to acetate).

Modeling analysis can be used to design gene disruptions that additionally optimize utilization of the pathway. One exemplary computational method for identifying and designing metabolic alterations favoring biosynthesis of a desired product is the OptKnock computational framework, Burgard et al., 2003, *Biotechnol. Bioeng.* 84: 647-657.

The host cells and fermenting organisms comprising a gene disruption may be constructed using methods well known in the art, including those methods described herein. A portion of the gene can be disrupted such as the coding region or a control sequence required for expression of the coding region. Such a control sequence of the gene may be a promoter sequence or a functional part thereof, i.e., a part that is sufficient for affecting expression of the gene. For example, a promoter sequence may be inactivated resulting in no expression or a weaker promoter may be substituted for the native promoter sequence to reduce expression of the coding sequence. Other control sequences for possible modification include, but are not limited to, a leader, propeptide sequence, signal sequence, transcription terminator, and transcriptional activator.

The host cells and fermenting organisms comprising a gene disruption may be constructed by gene deletion techniques to eliminate or reduce expression of the gene. Gene deletion techniques enable the partial or complete removal of the gene thereby eliminating their expression. In such methods, deletion of the gene is accomplished by homologous recombination using a plasmid that has been constructed to contiguously contain the 5' and 3' regions flanking the gene.

The host cells and fermenting organisms comprising a gene disruption may also be constructed by introducing, substituting, and/or removing one or more (e.g., two, several) nucleotides in the gene or a control sequence thereof required for the transcription or translation thereof. For example, nucleotides may be inserted or removed for the introduction of a stop codon, the removal of the start codon, or a frame-shift of the open reading frame. Such a modification may be accomplished by site-directed mutagenesis or PCR generated mutagenesis in accordance with methods known in the art. See, for example, Botstein and Shortle, 1985, *Science* 229: 4719; Lo et al., 1985, *Proc. Natl. Aced. Sci. U.S.A.* 81: 2285; Higuchi et al., 1988, *Nucleic Acids Res*

16: 7351; Shimada, 1996, *Meth. Mol. Biol.* 57: 157; Ho et al., 1989, *Gene* 77: 61; Horton et al., 1989, *Gene* 77: 61; and Sarkar and Sommer, 1990, *BioTechniques* 8: 404.

The host cells and fermenting organisms comprising a gene disruption may also be constructed by inserting into the gene a disruptive nucleic acid construct comprising a nucleic acid fragment homologous to the gene that will create a duplication of the region of homology and incorporate construct DNA between the duplicated regions. Such a gene disruption can eliminate gene expression if the inserted construct separates the promoter of the gene from the coding region or interrupts the coding sequence such that a non-functional gene product results. A disrupting construct may be simply a selectable marker gene accompanied by 5' and 3' regions homologous to the gene. The selectable marker enables identification of transformants containing the disrupted gene.

The host cells and fermenting organisms comprising a gene disruption may also be constructed by the process of gene conversion (see, for example, Iglesias and Trautner, 1983, *Molecular General Genetics* 189: 73-76). For example, in the gene conversion method, a nucleotide sequence corresponding to the gene is mutagenized in vitro to produce a defective nucleotide sequence, which is then transformed into the recombinant strain to produce a defective gene. By homologous recombination, the defective nucleotide sequence replaces the endogenous gene. It may be desirable that the defective nucleotide sequence also comprises a marker for selection of transformants containing the defective gene.

The host cells and fermenting organisms comprising a gene disruption may be further constructed by random or specific mutagenesis using methods well known in the art, including, but not limited to, chemical mutagenesis (see, for example, Hopwood, *The Isolation of Mutants in Methods in Microbiology* (J. R. Norris and D. W. Ribbons, eds.) pp. 363-433, Academic Press, New York, 1970). Modification of the gene may be performed by subjecting the parent strain to mutagenesis and screening for mutant strains in which expression of the gene has been reduced or inactivated. The mutagenesis, which may be specific or random, may be performed, for example, by use of a suitable physical or chemical mutagenizing agent, use of a suitable oligonucleotide, or subjecting the DNA sequence to PCR generated mutagenesis. Furthermore, the mutagenesis may be performed by use of any combination of these mutagenizing methods.

Examples of a physical or chemical mutagenizing agent suitable for the present purpose include ultraviolet (UV) irradiation, hydroxylamine, N-methyl-N'-nitro-N-nitrosoguanidine (MNNG), N-methyl-N'-nitrosogaunidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the parent strain to be mutagenized in the presence of the mutagenizing agent of choice under suitable conditions, and selecting for mutants exhibiting reduced or no expression of the gene.

A nucleotide sequence homologous or complementary to a gene described herein may be used from other microbial sources to disrupt the corresponding gene in a recombinant strain of choice.

In one embodiment, the modification of a gene in the recombinant cell is unmarked with a selectable marker. Removal of the selectable marker gene may be accomplished by culturing the mutants on a counter-selection medium. Where the selectable marker gene contains repeats flanking its 5' and 3' ends, the repeats will facilitate the looping out of the selectable marker gene by homologous recombination when the mutant strain is submitted to counter-selection. The selectable marker gene may also be removed by homologous recombination by introducing into the mutant strain a nucleic acid fragment comprising 5' and 3' regions of the defective gene, but lacking the selectable marker gene, followed by selecting on the counter-selection medium. By homologous recombination, the defective gene containing the selectable marker gene is replaced with the nucleic acid fragment lacking the selectable marker gene. Other methods known in the art may also be used.

Starch-Containing Material

Any suitable starch-containing material containing beta-glucan may be used according to the present invention. The starting material is generally selected based on the desired fermentation product. Examples of starch-containing materials, suitable for use in a process of the invention, include whole grains, corn, wheat, barley, rye, milo, sago, cassava, tapioca, sorghum, rice, peas, beans, or sweet potatoes, or mixtures thereof or starches derived there from, or cereals. Contemplated are also waxy and non-waxy types of corn and barley. In a preferred embodiment, the starch-containing material in a process for producing a fermentation product, wherein the fermentation product is ethanol, is corn or wheat.

Fermentation Products

The term "fermentation product" means a product produced by a process including a fermentation step using a fermenting organism. A fermentation product can be any substance derived from the fermentation. The fermentation product can be, without limitation, an alcohol (e.g., arabinitol, n-butanol, isobutanol, ethanol, glycerol, methanol, ethylene glycol, 1,3-propanediol [propylene glycol], butanediol, glycerin, sorbitol, and xylitol); an (e.g., pentane, hexane, heptane, octane, nonane, decane, undecane, and dodecane), a cycloalkane (e.g., cyclopentane, cyclohexane, cycloheptane, and cyclooctane), an alkene (e.g., pentene, hexene, heptene, and octene); an amino acid (e.g., aspartic acid, glutamic acid, glycine, lysine, serine, and threonine); a gas (e.g., methane, hydrogen ($H_2$), carbon dioxide ($CO_2$), and carbon monoxide (CO)); isoprene; a ketone (e.g., acetone); an organic acid (e.g., acetic acid, acetonic acid, adipic acid, ascorbic acid, citric acid, 2,5-diketo-D-gluconic acid, formic acid, fumaric acid, glucaric acid, gluconic acid, glucuronic acid, glutaric acid, 3-hydroxypropionic acid, itaconic acid, lactic acid, malic acid, malonic acid, oxalic acid, oxaloacetic acid, propionic acid, succinic acid, and xylonic acid); and polyketide.

In one embodiment, the fermentation product is an alcohol. The term "alcohol" encompasses a substance that contains one or more hydroxyl moieties. The alcohol can be, but is not limited to, n-butanol, isobutanol, ethanol, methanol, arabinitol, butanediol, ethylene glycol, glycerin, glycerol, 1,3-propanediol, sorbitol, xylitol. See, for example, Gong et al., 1999, Ethanol production from renewable resources, in *Advances in Biochemical Engineering/Biotechnology*, Scheper, T., ed., Springer-Verlag Berlin Heidelberg, Germany, 65: 207-241; Silveira and Jonas, 2002, *Appl. Microbiol. Biotechnol.* 59: 400-408; Nigam and Singh, 1995, *Process Biochemistry* 30(2): 117-124; Ezeji et al., 2003, *Word Journal of Microbiology and Biotechnology* 19(6): 595-603. In one embodiment, the fermentation product is ethanol.

In another embodiment, the fermentation product is an alkane. The alkane may be an unbranched or a branched alkane. The alkane can be, but is not limited to, pentane, hexane, heptane, octane, nonane, decane, undecane, or dodecane. In another embodiment, the fermentation product is a cycloalkane. The cycloalkane can be, but is not limited to, cyclopentane, cyclohexane, cycloheptane, or cyclooctane. In another aspect, the fermentation product is an alkene. The alkene may be an unbranched or a branched alkene. The alkalkaneene can be, but is not limited to, pentene, hexene, heptene, or octene.

In another aspect, the fermentation product is an amino acid. The amino acid can be, but is not limited to, aspartic acid, glutamic acid, glycine, lysine, serine, or threonine. See, for example, Richard and Margaritis, 2004, *Biotechnology and Bioengineering* 87(4): 501-515.

In another embodiment, the fermentation product is a gas. The gas can be, but is not limited to, methane, $H_2$, $CO_2$, or CO. See, for example, Kataoka et al., 1997, *Water Science and Technology* 36(6-7): 41-47; and Gunaseelan, 1997, *Biomass and Bioenergy* 13(1-2): 83-114.

In another embodiment, the fermentation product is antibiotics (e.g., penicillin and tetracycline).

In another embodiment, the fermentation product is isoprene.

In another embodiment, the fermentation product is an enzyme.

In another embodiment, the fermentation product is a hormone.

In another embodiment, the fermentation product is a ketone. The term "ketone" encompasses a substance that contains one or more ketone moieties. The ketone can be, but is not limited to, acetone.

In another embodiment, the fermentation product is an organic acid. The organic acid can be, but is not limited to, acetic acid, acetonic acid, adipic acid, ascorbic acid, citric acid, 2,5-diketo-D-gluconic acid, formic acid, fumaric acid, glucaric acid, gluconic acid, glucuronic acid, glutaric acid, 3-hydroxypropionic acid, itaconic acid, lactic acid, malic acid, malonic acid, oxalic acid, propionic acid, succinic acid, or xylonic acid. See, for example, Chen and Lee, 1997, *Appl. Biochem. Biotechnol.* 63-65: 435-448.

In another embodiment, the fermentation product is polyketide.

In a preferred embodiment the fermentation product is ethanol, e.g., fuel ethanol; drinking ethanol, i.e., potable neutral spirits; or industrial ethanol or products used in the consumable alcohol industry (e.g., beer and wine), dairy industry (e.g., fermented dairy products), leather industry and tobacco industry. Preferred beer types comprise ales, stouts, porters, lagers, bitters, malt liquors, happoushu, high-alcohol beer, low-alcohol beer, low-calorie beer or light beer. Preferably processes of the invention are used for producing an alcohol, such as ethanol. The fermentation product, such as ethanol, obtained according to the invention, may be used as fuel, which is typically blended with gasoline. However, in the case of ethanol it may also be used as potable ethanol.

Recovery

The fermentation product, e.g., ethanol, can optionally be recovered from the fermentation medium using any method known in the art including, but not limited to, chromatography, electrophoretic procedures, differential solubility, distillation, or extraction. For example, alcohol is separated from the fermented cellulosic material or fermented starch-containing material and purified by conventional methods of distillation. As another example, the desired fermentation product may be extracted from the fermentation medium by micro or membrane filtration techniques. Ethanol with a purity of up to about 96 vol. % can be obtained, which can be used as, for example, fuel ethanol, drinking ethanol, i.e., potable neutral spirits, or industrial ethanol.

In some embodiments of the methods, the fermentation product after being recovered is substantially pure. With respect to the methods herein, "substantially pure" intends a recovered preparation that contains no more than 15% impurity, wherein impurity intends compounds other than the fermentation product (e.g., ethanol). In one variation, a substantially pure preparation is provided wherein the preparation contains no more than 25% impurity, or no more than 20% impurity, or no more than 10% impurity, or no more than 5% impurity, or no more than 3% impurity, or no more than 1% impurity, or no more than 0.5% impurity.

Suitable assays to test for the production of ethanol and contaminants, and sugar consumption can be performed using methods known in the art. For example, ethanol product, as well as other organic compounds, can be analyzed by methods such as HPLC (High Performance Liquid Chromatography), GC-MS (Gas Chromatography Mass Spectroscopy) and LC-MS (Liquid Chromatography-Mass Spectroscopy) or other suitable analytical methods using routine procedures well known in the art. The release of ethanol in the fermentation broth can also be tested with the culture supernatant. Byproducts and residual sugar in the fermentation medium (e.g., glucose or xylose) can be quantified by HPLC using, for example, a refractive index detector for glucose and alcohols, and a UV detector for organic acids (Lin et al., *Biotechnol. Bioeng.* 90:775-779 (2005)), or using other suitable assay and detection methods well known in the art.

Alpha-Amylase Present and/or Added During Liquefaction

According to the invention an alpha-amylase is present and/or added during liquefaction together with an optional thermostable protease, optional carbohydrate-source generating enzyme, in particular a thermostable glucoamylase, and/or optional pullulanase.

The alpha-amylase added during liquefaction step i) may be any alpha-amylase. Preferred are bacterial alpha-amylases, which typically are stable at temperature used during liquefaction.

Any alpha-amylase herein contemplated as being present and/or added during liquefaction is also contemplated for expression by a fermenting organism or host cell.

The term "bacterial alpha-amylase" means any bacterial alpha-amylase classified under EC 3.2.1.1. A bacterial alpha-amylase used according to the invention may, e.g., be derived from a strain of the genus *Bacillus*, which is sometimes also referred to as the genus *Geobacillus*. In an embodiment the *Bacillus* alpha-amylase is derived from a strain of *Bacillus amyloliquefaciens, Bacillus licheniformis, Bacillus stearothermophilus*, or *Bacillus subtilis*, but may also be derived from other *Bacillus* sp.

Specific examples of bacterial alpha-amylases include the *Bacillus stearothermophilus* alpha-amylase of SEQ ID NO: 3 in WO 99/19467, the *Bacillus amyloliquefaciens* alpha-amylase of SEQ ID NO: 5 in WO 99/19467, and the *Bacillus licheniformis* alpha-amylase of SEQ ID NO: 4 in WO 99/19467 (all sequences are hereby incorporated by reference). In an embodiment the alpha-amylase may be an enzyme having a degree of identity of at least 60%, e.g., at least 70%, at least 80%, at least 90%, at least 95%, at least 96%, at least 97%, at least 98% or at least 99% identity to any of the sequences shown in SEQ ID NOS: 3, 4 or 5, respectively, in WO 99/19467.

In an embodiment the alpha-amylase may be an enzyme having a degree of identity of at least 60%, e.g., at least 70%, at least 80%, at least 90%, at least 91%, at least 92%, at least 93%, at least 94%, at least 95%, at least 96%, at least 97%, at least 98% or at least 99% identity to any of the sequences shown in SEQ ID NO: 3 in WO 99/19467 or SEQ ID NO: 126 herein.

In a preferred embodiment the alpha-amylase is derived from *Bacillus stearothermophilus*. The *Bacillus stearothermophilus* alpha-amylase may be a mature wild-type or a mature variant thereof. The mature *Bacillus stearothermophilus* alpha-amylases may naturally be truncated during recombinant production. For instance, the *Bacillus stearothermophilus* alpha-amylase may be a truncated so it has around 491 amino acids compared to SEQ ID NO: 3 in WO 99/19467.

The *Bacillus* alpha-amylase may also be a variant and/or hybrid. Examples of such a variant can be found in any of WO 96/23873, WO 96/23874, WO 97/41213, WO 99/19467, WO 00/60059, and WO 02/10355 (all documents are hereby incorporated by reference). Specific alpha-amylase variants are disclosed in U.S. Pat. Nos. 6,093,562, 6,187,576, 6,297,038, and 7,713,723 (hereby incorporated by reference) and include *Bacillus stearothermophilus* alpha-amylase (often referred to as BSG alpha-amylase) variants having a deletion of one or two amino acids at positions R179, G180, I181 and/or G182, preferably a double deletion disclosed in WO 96/23873—see, e.g., page 20, lines 1-10 (hereby incorporated by reference), preferably corresponding to deletion of positions I181 and G182 compared to the amino acid sequence of *Bacillus stearothermophilus* alpha-amylase set forth in SEQ ID NO: 3 disclosed in WO 99/19467 or SEQ ID NO: 126 herein or the deletion of amino acids R179 and G180 using SEQ ID NO: 3 in WO 99/19467 or SEQ ID NO: 126 herein for numbering (which reference is hereby incorporated by reference). Even more preferred are *Bacillus* alpha-amylases, especially *Bacillus stearothermophilus* alpha-amylases, which have a double deletion corresponding to a deletion of positions 181 and 182 and further comprise a N193F substitution (also denoted I181*+G182*+N193F) compared to the wild-type BSG alpha-amylase amino acid sequence set forth in SEQ ID NO: 3 disclosed in WO 99/19467 or SEQ ID NO: 126 herein. The bacterial alpha-amylase may also have a substitution in a position corresponding to S239 in the *Bacillus licheniformis* alpha-amylase shown in SEQ ID NO: 4 in WO 99/19467, or a S242 variant of the *Bacillus stearothermophilus* alpha-amylase of SEQ ID NO: 3 in WO 99/19467 or SEQ ID NO: 30 herein.

In an embodiment the variant is a S242A, E or Q variant, preferably a S242Q variant, of the *Bacillus stearothermophilus* alpha-amylase (using SEQ ID NO: 126 herein for numbering).

In an embodiment, the variant is a position E188 variant, preferably E188P variant of the *Bacillus stearothermophilus* alpha-amylase (using SEQ ID NO: 126 herein for numbering).

The bacterial alpha-amylase may in an embodiment be a truncated alpha-amylase. Especially the truncation is so that the *Bacillus stearothermophilus* alpha-amylase shown in SEQ ID NO: 3 in WO 99/19467 or SEQ ID NO: 126 herein, is around 491 amino acids long, such as from 480 to 495 amino acids long.

Most importantly, a suitable alpha-amylase for use in liquefaction must have sufficient therm-stability, and thus accordingly any alpha-amylase having a T½ (min) at pH 4.5, 85° C., 0.12 mM CaCl$_2$) of at least 10, such as at least 15, such as at least 20, such as at least 25, such as at least 30, such as at least 40, such as at least 50, such as at least 60, such as between 10-70, such as between 15-70, such as between 20-70, such as between 25-70, such as between 30-70, such as between 40-70, such as between 50-70, such as between 60-70, may be used.

According to the invention the alpha-amylase may be a thermostable alpha-amylase, such as a thermostable bacterial alpha-amylase, preferably from *Bacillus stearothermophilus*. In an embodiment the alpha-amylase used according to the invention has a T½ (min) at pH 4.5, 85° C., 0.12 mM CaCl$_2$ of at least 10.

In an embodiment the thermostable alpha-amylase has a T½ (min) at pH 4.5, 85° C., 0.12 mM CaCl$_2$, of at least 15.

In an embodiment the thermostable alpha-amylase has a T½ (min) at pH 4.5, 85° C., 0.12 mM CaCl$_2$, of as at least 20.

In an embodiment the thermostable alpha-amylase has a T½ (min) at pH 4.5, 85° C., 0.12 mM CaCl$_2$, of as at least 25.

In an embodiment the thermostable alpha-amylase has a T½ (min) at pH 4.5, 85° C., 0.12 mM CaCl$_2$, of as at least 30.

In an embodiment the thermostable alpha-amylase has a T½ (min) at pH 4.5, 85° C., 0.12 mM CaCl$_2$, of as at least 40.

In an embodiment the thermostable alpha-amylase has a T½ (min) at pH 4.5, 85° C., 0.12 mM CaCl$_2$, of at least 50.

In an embodiment the thermostable alpha-amylase has a T½ (min) at pH 4.5, 85° C., 0.12 mM CaCl$_2$, of at least 60.

In an embodiment the thermostable alpha-amylase has a T½ (min) at pH 4.5, 85° C., 0.12 mM CaCl$_2$, between 10-70.

In an embodiment the thermostable alpha-amylase has a T½ (min) at pH 4.5, 85° C., 0.12 mM CaCl$_2$, between 15-70.

In an embodiment the thermostable alpha-amylase has a T½ (min) at pH 4.5, 85° C., 0.12 mM CaCl$_2$, between 20-70.

In an embodiment the thermostable alpha-amylase has a T½ (min) at pH 4.5, 85° C., 0.12 mM CaCl$_2$, between 25-70.

In an embodiment the thermostable alpha-amylase has a T½ (min) at pH 4.5, 85° C., 0.12 mM CaCl$_2$, between 30-70.

In an embodiment the thermostable alpha-amylase has a T½ (min) at pH 4.5, 85° C., 0.12 mM CaCl$_2$, between 40-70.

In an embodiment the thermostable alpha-amylase has a T½ (min) at pH 4.5, 85° C., 0.12 mM CaCl$_2$, between 50-70.

In an embodiment the thermostable alpha-amylase has a T½ (min) at pH 4.5, 85° C., 0.12 mM CaCl$_2$, between 60-70.

In an embodiment of the invention the alpha-amylase is an bacterial alpha-amylase, preferably derived from the genus *Bacillus*, especially a strain of *Bacillus stearothermophilus*, in particular the *Bacillus stearothermophilus* as disclosed in WO 99/019467 as SEQ ID NO: 3 (SEQ ID NO: 126 herein) with one or two amino acids deleted at positions R179, G180, I181 and/or G182, in particular with R179 and G180 deleted, or with I181 and G182 deleted, with mutations in below list of mutations.

In preferred embodiments, the *Bacillus stearothermophilus* alpha-amylases have double deletion I181+G182, and optional substitution N193F, further comprising mutations selected from below list.

In a preferred embodiment, the alpha-amylase is selected from the following group of *Bacillus stearothermophilus* alpha-amylase variants (using SEQ ID NO: 126 for numbering):

I181*+G182*+N193F+E129V+K177L+R179E;
I181*+G182*+N193F+E129V+K177L+R179S;
I181*+G182*+N193F+V59A+Q89R+E129V+K177L+ R179E+H208Y+K220P+N224L+Q254S
I181*+G182*+N193F+V59A+Q89R+E129V+K177L+ R179E+Q254S+M284V;

I181*+G182*+N193F+V59A+Q89R+E129V+K177L+ R179S+Q254S+M284V; −I181*+G182*+N193F+ V59A+E129V+K177L+R179E+Q254S+M284V;
I181*+G182*+N193F+V59A+E129V+K177L+R179S+ Q254S+M284V; −I181*+G182*+N193F+E129V+ K177L+R179E+K220P+N224L+S242Q+Q254S;
I181*+G182*+N193F+E129V+K177L+R179S+K220P+ N224L+S242Q+Q254S;
I181*+G182*+V59A+E129V+K177L+R179E+Q254S+ M284V+V212T+Y268G+N293Y+T297N;
I181*+G182*+V59A+E129V+K177L+R179E+Q254S+ M284V+V212T+Y268G+N293Y+T297N+S173N+ E188P+H208Y+S242Y+K2791;
I181*+G182*+V59A+E129V+K177L+R179S+Q254S+ M284V+V212T+Y268G+N293Y+T297N+A184Q+ E188P+T191N
I181*+G182*+V59A+E129V+K177L+R179S+Q254S+ M284V+V212T+Y268G+N293Y+T297N+A184Q+ E188P+T191N+S242Y+K2791;
I181*+G182*+V59A+E129V+K177L+R179E+Q254S+ M284V+V212T+Y268G+N293Y+T297N+E188P+ K279W;
I181*+G182*+V59A+E129V+K177L+R179E+Q254S+ M284V+V212T+Y268G+N293Y+T297N+W115D+ D117Q+T133P; and
wherein the variant has at least 85%, at least 90%, at least 95%, at least 96%, at least 97%, at least 98%, or at least 99% sequence identity to SEQ ID NO: 126.

It should be understood, that when referring to *Bacillus stearothermophilus* alpha-amylase and variants thereof they are normally produced in truncated form. In particular, the truncation may be so that the *Bacillus stearothermophilus* alpha-amylase shown in SEQ ID NO: 3 in WO 99/19467 or SEQ ID NO: 126 herein, or variants thereof, are truncated in the C-terminal and are typically around 491 amino acids long, such as from 480-495 amino acids long.

In a preferred embodiment the alpha-amylase variant may be an enzyme having a degree of identity of at least 60%, e.g., at least 70%, at least 80%, at least 90%, at least 95%, at least 91%, at least 92%, at least 93%, at least 94%, at least 95%, at least 96%, at least 97%, at least 98% or at least 99%, but less than 100% to the sequence shown in SEQ ID NO: 3 in WO 99/19467 or SEQ ID NO: 126 herein.

Protease Present and/or Added During Liquefaction

According to the invention a thermostable protease is optionally present and/or added during liquefaction together with an alpha-amylase, and optionally a carbohydrate-source generating enzyme, in particular a thermostable glucoamylase, and/or optionally a pullulanase.

Any protease herein contemplated as being present and/or added during liquefaction is also contemplated for expression by a fermenting organism or host cell.

Proteases are classified on the basis of their catalytic mechanism into the following groups: Serine proteases (S), Cysteine proteases (C), Aspartic proteases (A), Metallo proteases (M), and Unknown, or as yet unclassified, proteases (U), see Handbook of Proteolytic Enzymes, A. J. Barrett, N. D. Rawlings, J. F. Woessner (eds), Academic Press (1998), in particular the general introduction part.

In a preferred embodiment the thermostable protease used according to the invention is a "metallo protease" defined as a protease belonging to EC 3.4.24 (metalloendopeptidases); preferably EC 3.4.24.39 (acid metallo proteinases).

To determine whether a given protease is a metallo protease or not, reference is made to the above "Handbook of Proteolytic Enzymes" and the principles indicated therein. Such determination can be carried out for all types of proteases, be it naturally occurring or wild-type proteases; or genetically engineered or synthetic proteases.

Protease activity can be measured using any suitable assay, in which a substrate is employed, that includes peptide bonds relevant for the specificity of the protease in question. Assay-pH and assay-temperature are likewise to be adapted to the protease in question. Examples of assay-pH-values are pH 6, 7, 8, 9, 10, or 11. Examples of assay-temperatures are 30, 35, 37, 40, 45, 50, 55, 60, 65, 70 or 80° C.

Examples of protease substrates are casein, such as Azurine-Crosslinked Casein (AZCL-casein). Two protease assays are described below in the "Materials & Methods"-section, of which the so-called "AZCL-Casein Assay" is the preferred assay.

In an embodiment the thermostable protease has at least 20%, such as at least 30%, such as at least 40%, such as at least 50%, such as at least 60%, such as at least 70%, such as at least 80%, such as at least 90%, such as at least 95%, such as at least 100% of the protease activity of the Protease 196 variant or Protease Pfu determined by the AZCL-casein assay described in the "Materials & Methods" section.

There are no limitations on the origin of the protease used in a process of the invention as long as it fulfills the thermostability properties defined below.

In one embodiment the protease is of fungal origin.

The protease may be a variant of, e.g., a wild-type protease as long as the protease has the thermostability properties defined herein.

In a particular embodiment the thermostable protease is a variant of a metallo protease as defined above. In an embodiment the thermostable protease used in a process of the invention is of fungal origin, such as a fungal metallo protease, such as a fungal metallo protease derived from a strain of the genus *Thermoascus*, preferably a strain of *Thermoascus aurantiacus*, especially *Thermoascus aurantiacus* CGMCC No. 0670 (classified as EC 3.4.24.39).

In an embodiment the thermostable protease is a variant of the mature part of the metallo protease shown in SEQ ID NO: 2 disclosed in WO 2003/048353 or the mature part of SEQ ID NO: 1 in WO 2010/008841 and shown as SEQ ID NO: 127 herein further with mutations selected from below list:

S5*+D79L+S87P+A112P+D142L;
D79L+S87P+A112P+T124V+D142L;
S5*+N26R+D79L+S87P+A112P+D142L;
N26R+T46R+D79L+S87P+A112P+D142L;
T46R+D79L+S87P+T116V+D142L;
D79L+P81R+S87P+A112P+D142L;
A27K+D79L+S87P+A112P+T124V+D142L;
D79L+Y82F+S87P+A112P+T124V+D142L;
D79L+Y82F+S87P+A112P+T124V+D142L;
D79L+S87P+A112P+T124V+A126V+D142L;
D79L+S87P+A112P+D142L;
D79L+Y82F+S87P+A112P+D142L;
S38T+D79L+S87P+A112P+A126V+D142L;
D79L+Y82F+S87P+A112P+A126V+D142L;
A27K+D79L+S87P+A112P+A126V+D142L;
D79L+S87P+N98C+A112P+G135C+D142L;
D79L+S87P+A112P+D142L+T141C+M161C;
S36P+D79L+S87P+A112P+D142L;
A37P+D79L+S87P+A112P+D142L;
S49P+D79L+S87P+A112P+D142L;
S50P+D79L+S87P+A112P+D142L;
D79L+S87P+D104P+A112P+D142L;
D79L+Y82F+S87G+A112P+D142L;
S70V+D79L+Y82F+S87G+Y97W+A112P+D142L;
D79L+Y82F+S87G+Y97W+D104P+A112P+D142L;

S70V+D79L+Y82F+S87G+A112P+D142L;
D79L+Y82F+S87G+D104P+A112P+D142L;
D79L+Y82F+S87G+A112P+A126V+D142L;
Y82F+S87G+S70V+D79L+D104P+A112P+D142L;
Y82F+S87G+D79L+D104P+A112P+A126V+D142L;
A27K+D79L+Y82F+S87G+D104P+A112P+A126V+D142L;
A27K+Y82F+S87G+D104P+A112P+A126V+D142L;
A27K+D79L+Y82F+D104P+A112P+A126V+D142L;
A27K+Y82F+D104P+A112P+A126V+D142L;
A27K+D79L+S87P+A112P+D142L;
D79L+S87P+D142L.

In a preferred embodiment the thermostable protease is a variant of the metallo protease disclosed as the mature part of SEQ ID NO: 2 disclosed in WO 2003/048353 or the mature part of SEQ ID NO: 1 in WO 2010/008841 or SEQ ID NO: 127 herein with the following mutations:
D79L+S87P+A112P+D142L;
D79L+S87P+D142L; or
A27K+D79L+Y82F+S87G+D104P+A112P+A126V+D142L.

In an embodiment the protease variant has at least 75% identity preferably at least 80%, more preferably at least 85%, more preferably at least 90%, more preferably at least 91%, more preferably at least 92%, even more preferably at least 93%, most preferably at least 94%, and even most preferably at least 95%, such as even at least 96%, at least 97%, at least 98%, at least 99%, but less than 100% identity to the mature part of the polypeptide of SEQ ID NO: 2 disclosed in WO 2003/048353 or the mature part of SEQ ID NO: 1 in WO 2010/008841 or SEQ ID NO: 127 herein.

The thermostable protease may also be derived from any bacterium as long as the protease has the thermostability properties defined according to the invention. In one embodiment the protease is a serine protease, particularly a S8 protease. Preferred proteases are, serine proteases, particularly an S8 serine protease derived from a strain of *Pyrococcus*, preferably a strain of *Pyrococcus furiosus*, or derived from a strain of *Thermococcus*, preferably *Themococcus thioreducens*, or derived from a strain of *Palaeococcus*, preferably *Palaeococcus ferrophilus*.

In an embodiment the thermostable protease is derived from a strain of the bacterium *Pyrococcus*, such as a strain of *Pyrococcus furiosus* (pfu protease).

In an embodiment the protease is one shown as SEQ ID NO: 1 in U.S. Pat. No. 6,358,726-B1 (Takara Shuzo Company), SEQ ID NO: 128 herein.

In another embodiment the thermostable protease is one disclosed in SEQ ID NO: 128 herein or a protease having at least 80% identity, such as at least 85%, such as at least 90%, such as at least 95%, such as at least 96%, such as at least 97%, such as at least 98%, such as at least 99% identity to SEQ ID NO: 1 in U.S. Pat. No. 6,358,726-B1 or SEQ ID NO: 128 herein.

The *Pyrococcus furiosus* protease is a thermostable protease according to the invention. The *Pyrococcus* fuiosus protease (PfuS) was found to have a thermostability of 110% (80° C./70° C.) and 103% (90° C./70° C.) at pH 4.5 determined as described in Example 2 herein.

In an embodiment the thermostable protease is derived from a strain of the bacterium *Palaeococcus*, such as a strain of *Palaeococcus ferrophilus*. In an embodiment the protease is the one shown as SEQ ID NO: 129 herein. In another embodiment the thermostable protease is one disclosed in SEQ ID NO: 129 herein or a protease having at least 80% identity, such as at least 85%, such as at least 90%, such as at least 95%, such as at least 96%, such as at least 97%, such as at least 98%, such as at least 99% identity to SEQ ID NO: 129.

In one embodiment a thermostable protease used in a process of the invention has a thermostability value of more than 20% determined as Relative Activity at 80° C./70° C. determined as described in Example 2.

In an embodiment the protease has a thermostability of more than 30%, more than 40%, more than 50%, more than 60%, more than 70%, more than 80%, more than 90%, more than 100%, such as more than 105%, such as more than 110%, such as more than 115%, such as more than 120% determined as Relative Activity at 80° C./70° C.

In an embodiment protease has a thermostability of between 20 and 50%, such as between 20 and 40%, such as 20 and 30% determined as Relative Activity at 80° C./70° C.

In an embodiment the protease has a thermostability between 50 and 115%, such as between 50 and 70%, such as between 50 and 60%, such as between 100 and 120%, such as between 105 and 115% determined as Relative Activity at 80° C./70° C.

In an embodiment the protease has a thermostability value of more than 10% determined as Relative Activity at 85° C./70° C. determined as described in Example 2.

In an embodiment the protease has a thermostability of more than 10%, such as more than 12%, more than 14%, more than 16%, more than 18%, more than 20%, more than 30%, more than 40%, more that 50%, more than 60%, more than 70%, more than 80%, more than 90%, more than 100%, more than 110% determined as Relative Activity at 85° C./70° C.

In an embodiment the protease has a thermostability of between 10 and 50%, such as between 10 and 30%, such as between 10 and 25% determined as Relative Activity at 85° C./70° C.

In an embodiment the protease has more than 20%, more than 30%, more than 40%, more than 50%, more than 60%, more than 70%, more than 80%, more than 90% determined as Remaining Activity at 80° C.; and/or In an embodiment the protease has more than 20%, more than 30%, more than 40%, more than 50%, more than 60%, more than 70%, more than 80%, more than 90% determined as Remaining Activity at 84° C.

Determination of "Relative Activity" and "Remaining Activity" is done as described in Example 2.

In an embodiment the protease may have a thermostability for above 90, such as above 100 at 85° C. as determined using the Zein-BCA assay as disclosed in Example 3.

In an embodiment the protease has a thermostability above 60%, such as above 90%, such as above 100%, such as above 110% at 85° C. as determined using the Zein-BCA assay.

In an embodiment protease has a thermostability between 60-120, such as between 70-120%, such as between 80-120%, such as between 90-120%, such as between 100-120%, such as 110-120% at 85° C. as determined using the Zein-BCA assay.

In an embodiment the thermostable protease has at least 20%, such as at least 30%, such as at least 40%, such as at least 50%, such as at least 60%, such as at least 70%, such as at least 80%, such as at least 90%, such as at least 95%, such as at least 100% of the activity of the JTP196 protease variant or Protease Pfu determined by the AZCL-casein assay.

In an embodiment the protease is derived from a strain of *Thermobifida*, such as the *Thermobifida cellulosytica* protease shown in SEQ ID NO: 139 herein, or one having at least 60%, such as at least 70%, such as at least 75% identity, at least 76% identity, at least 77% identity, at least 78% identity, at least 79% identity, preferably at least 80%, at least 81% identity, at least 82% identity, at least 83% identity, at least 84% identity, more preferably at least 85% identity, at least 86% identity, at least 87% identity, at least 88% identity, at least 89% identity, more preferably at least 90% identity, more preferably at least 91% identity, more preferably at least 92% identity, at least 93% identity, at least 94% identity, or at least 95% identity, such as at least 96% identity, at least 97% identity, at least 98% identity, at least 99% identity to the amino acid sequence of SEQ ID NO: 139.

In an embodiment the protease is derived from a strain of *Thermobifida*, such as the *Thermobifida fusca* protease shown in SEQ ID NO: 140 herein (referred to as SEQ ID NO: 8 in WO2018/118815 A1, which is incorporated herein by reference in its entirety), or one having at least 60%, such as at least 70%, such as at least 75% identity, at least 76% identity, at least 77% identity, at least 78% identity, at least 79% identity, preferably at least 80%, at least 81% identity, at least 82% identity, at least 83% identity, at least 84% identity, more preferably at least 85% identity, at least 86% identity, at least 87% identity, at least 88% identity, at least 89% identity, more preferably at least 90% identity, more preferably at least 91% identity, more preferably at least 92% identity, at least 93% identity, at least 94% identity, or at least 95% identity, such as at least 96% identity, at least 97% identity, at least 98% identity, at least 99% identity to the amino acid sequence of SEQ ID NO: 140.

In an embodiment the protease is derived from a strain of *Thermobifida*, such as the *Thermobifida halotolerans* protease shown in SEQ ID NO: 141 herein (referred to as SEQ ID NO: 10 in V2018/118815 A1, which is incorporated herein by reference in its entirety), or one having at least 60%, such as at least 70%, such as at least 75% identity, at least 76% identity, at least 77% identity, at least 78% identity, at least 79% identity, preferably at least 80%, at least 81% identity, at least 82% identity, at least 83% identity, at least 84% identity, more preferably at least 85% identity, at least 86% identity, at least 87% identity, at least 88% identity, at least 89% identity, more preferably at least 90% identity, more preferably at least 91% identity, more preferably at least 92% identity, at least 93% identity, at least 94% identity, or at least 95% identity, such as at least 96% identity, at least 97% identity, at least 98% identity, at least 99% identity to the amino acid sequence of SEQ ID NO: 141.

In an embodiment the protease is derived from a strain of *Thermococcus*, such as the *Thermococcus nautili* protease shown in SEQ ID NO: 142 herein (referred to as SEQ ID NO: 3 in WO2018/169780A1, which is incorporated herein by reference in its entirety), or one having at least 60%, such as at least 70%, such as at least 75% identity, at least 76% identity, at least 77% identity, at least 78% identity, at least 79% identity, preferably at least 80%, at least 81% identity, at least 82% identity, at least 83% identity, at least 84% identity, more preferably at least 85% identity, at least 86% identity, at least 87% identity, at least 88% identity, at least 89% identity, more preferably at least 90% identity, more preferably at least 91% identity, more preferably at least 92% identity, at least 93% identity, at least 94% identity, or at least 95% identity, such as at least 96% identity, at least 97% identity, at least 98% identity, at least 99% identity to the amino acid sequence of SEQ ID NO: 142.

Carbohydrate-Source Generating Enzyme Present and/or Added During Liquefaction

According to the invention a carbohydrate-source generating enzyme, in particular a glucoamylase, preferably a thermostable glucoamylase, may optionally be present and/or added during liquefaction together with an alpha-amylase and an optional thermostable protease. As mentioned above, a pullulanase may also be optionally be present and/or added during liquefaction step i).

Any carbohydrate-source generating enzymes (e.g., glucoamylase) herein contemplated as being present and/or added during liquefaction is also contemplated for expression by a fermenting organism or host cell.

The term "carbohydrate-source generating enzyme" includes any enzymes generating fermentable sugars. A carbohydrate-source generating enzyme is capable of producing a carbohydrate that can be used as an energy-source by the fermenting organism(s) in question, for instance, when used in a process of the invention for producing a fermentation product, such as ethanol. The generated carbohydrates may be converted directly or indirectly to the desired fermentation product, preferably ethanol. According to the invention a mixture of carbohydrate-source generating enzymes may be used. Specific examples include glucoamylase (being glucose generators), beta-amylase and maltogenic amylase (being maltose generators).

In a preferred embodiment the carbohydrate-source generating enzyme is thermostable. The carbohydrate-source generating enzyme, in particular thermostable glucoamylase, may be added together with or separately from the alpha-amylase and the thermostable protease.

In a specific and preferred embodiment the carbohydrate-source generating enzyme is a thermostable glucoamylase, preferably of fungal origin, preferably a filamentous fungi, such as from a strain of the genus *Penicillium*, especially a strain of *Penicillium oxalicum*, in particular the *Penicillium oxalicum* glucoamylase disclosed as SEQ ID NO: 2 in PCT/CN10/071753 published as WO 2011/127802 (which is hereby incorporated by reference) and shown in SEQ ID NO: 130 herein.

In an embodiment the thermostable glucoamylase has at least 80%, more preferably at least 85%, more preferably at least 90%, more preferably at least 91%, more preferably at least 92%, even more preferably at least 93%, most preferably at least 94%, and even most preferably at least 95%, such as even at least 96%, at least 97%, at least 98%, at least 99% or 100% identity to the mature polypeptide shown in SEQ ID NO: 2 in WO 2011/127802 or SEQ ID NOs: 130 herein.

In a preferred embodiment the carbohydrate-source generating enzyme is a variant of the *Penicillium oxalicum* glucoamylase disclosed as SEQ ID NO: 2 in WO 2011/127802 and SEQ ID NO: 130 herein, having a K79V substitution (using the mature sequence shown in SEQ ID NO: 34 for numbering). The K79V glucoamylase variant has reduced sensitivity to protease degradation relative to the parent as disclosed in U.S. application No. 61/531,189 or PCT/US12/053779 (which are hereby incorporated by reference).

In an embodiment the carbohydrate-source generating enzyme, in particular thermostable glucoamylase, is derived from *Penicillium oxalicum*.

In an embodiment the thermostable glucoamylase is a variant of the *Penicillium oxalicum* glucoamylase disclosed as SEQ ID NO: 2 in WO 2011/127802 and shown in SEQ ID NO: 130 herein. In a preferred embodiment the *Penicillium oxalicum* glucoamylase is the one disclosed as SEQ ID NO: 2 in WO 2011/127802 and shown in SEQ ID NO: 130 herein having Val (V) in position 79 (using SEQ ID NO: 34 for numbering).

In an embodiment these variants have reduced sensitivity to protease degradation.

In an embodiment these variants have improved thermostability compared to the parent.

More specifically, in an embodiment the glucoamylase has a K79V substitution (using SEQ ID NO: 130 for numbering), corresponding to the PE001 variant, and further comprises at least one of the following substitutions or combination of substitutions:

P11F+T65A+Q327F; or
P2N+P4S+P11F+T65A+Q327F; or
P11F+D26C+K33C+T65A+Q327F; or
P2N+P4S+P11F+T65A+Q327W+E501V+Y504T; or
P2N+P4S+P11F+T65A+Q327F+E501V+Y504T; or
P11F+T65A+Q327W+E501V+Y504T.

The carbohydrate-source generating enzyme, in particular, may be added in amounts from 0.1-100 micrograms EP/g, such as 0.5-50 micrograms EP/g, such as 1-25 micrograms EP/g, such as 2-12 micrograms EP/g DS.

Carbohydrate-Source Generating Enzyme Present and/or Added During Saccharification and/or Fermentation According to the invention a carbohydrate-source generating enzyme, preferably a glucoamylase, may be present and/or added during saccharification and/or fermentation.

In a preferred embodiment the carbohydrate-source generating enzyme is a glucoamylase, of fungal origin, preferably from a stain of *Aspergillus*, preferably *A. niger*, *A. awamori*, or *A. oryzae*; or a strain of *Trichoderma*, preferably *T. reesei*; or a strain of *Talaromyces*, preferably *T. emersonii*, or a strain of *Trametes*, preferably *Trametes cingulata*, or a strain of *Pycnoporus*, or a strain of *Gloeophyllum*, such as a strain of *Gloeophyllum sepiarium* or *Gloeophyllum trabeum* or a strain of the *Nigrofomes*.

Any glucoamylase contemplated as being present and/or added during saccharification and/or fermentation is also contemplated for expression by a fermenting organism or host cell.

Glucoamylases

According to the invention the glucoamylase present and/or added during saccharification and/or fermentation may be derived from any suitable source, e.g., derived from a microorganism or a plant. Preferred glucoamylases are of fungal or bacterial origin, selected from the group consisting of *Aspergillus* glucoamylases, in particular *Aspergillus niger* G1 or G2 glucoamylase (Boel et al. (1984), *EMBO J.* 3 (5), p. 1097-1102), or variants thereof, such as those disclosed in WO 92/00381, WO 00/04136 and WO 01/04273 (from Novozymes, Denmark); the *A. awamori* glucoamylase disclosed in WO 84/02921, *Aspergillus oryzae* glucoamylase (*Agric. Biol. Chem.* (1991), 55 (4), p. 941-949), or variants or fragments thereof. Other *Aspergillus* glucoamylase variants include variants with enhanced thermal stability: G137A and G139A (Chen et al. (1996), Prot. Eng. 9, 499-505); D257E and D293E/Q (Chen et al. (1995), Prot. Eng. 8, 575-582); N182 (Chen et al. (1994), Biochem. J. 301, 275-281); disulphide bonds, A246C (Fierobe et al. (1996), Biochemistry, 35, 8698-8704; and introduction of Pro residues in position A435 and S436 (Li et al. (1997), Protein Eng. 10, 1199-1204).

Other glucoamylases include *Athelia rolfsii* (previously denoted *Corticium rofsii*) glucoamylase (see U.S. Pat. No. 4,727,026 and (Nagasaka et al. (1998) "Purification and properties of the raw-starch-degrading glucoamylases from *Corticium rolfsii*, Appl Microbiol Biotechnol 50:323-330), *Talaromyces* glucoamylases, in particular derived from *Talaromyces emersonii* (WO 99/28448), *Talaromyces leycettanus* (US patent no. Re. 32,153), *Talaromyces duponti*, *Talaromyces thermophilus* (U.S. Pat. No. 4,587,215). In a preferred embodiment the glucoamylase used during saccharification and/or fermentation is the *Talaromyces emersonii* glucoamylase disclosed in WO 99/28448.

Contemplated fungal glucoamylases include particularly glucoamylases derived from *Talaromyces*, preferably *T. emersonii*, or a strain of *Trametes*, preferably *Trametes cingulata*, or a strain of *Pycnoporus*, or a strain of *Gloeophyllum*, such as a strain of *Gloeophyllum sepiarium* or *Gloeophyllum trabeum* or a strain of the *Nigrofomes*.

In one embodiment the glucoamylase is derived from a strain of the genus *Trametes*, in particular a strain of *Trametes cingulata*, disclosed in WO 2006/069289 or in SEQ ID NO: 131 herein. In one embodiment the glucoamylase is derived from a strain of the genus *Talaromyces*, in particular a strain of *Talaromyces emersonii* disclosed in SEQ ID NO: 132 herein.

In another embodiment the glucoamylase is derived from a strain of the genus *Pycnoporus*, in particular a strain of *Pycnoporus sanguineus* as described in WO 2011/066576 (SEQ ID NOs 2, 4 or 6) or SEQ ID NO: 133 herein, or from a strain of the genus *Gloeophyllum*, such as a strain of *Gloeophyllum sepiarium* or *Gloeophyllum trabeum*, in particular a strain of *Gloeophyllum* as described in WO 2011/068803 (SEQ ID NO: 2, 4, 6, 8, 10, 12, 14 or 16). In a preferred embodiment the glucoamylase is SEQ ID NO: 134 herein. In another embodiment the glucoamylase is SEQ ID NO: 135 herein. In an embodiment the glucoamylase is derived from a strain of the genus *Nigrofomes*, in particular a strain of *Nigrofomes* sp. disclosed in WO 2012/064351 as SEQ ID NO: 2. Contemplated are also glucoamylases which exhibit a high identity to any of the above mentioned glucoamylases, i.e., at least 70%, at least 75%, at least 80%, at least 85%, at least 90%, at least 95%, at least 96%, at least 97%, at least 98%, at least 99% or even 100% identity to any one of the mature parts of the enzyme sequences mentioned above, such as any of SEQ ID NOs: 131, 132, 133, 134, or 135 herein.

Glucoamylases may in an embodiment be added to the saccharification and/or fermentation in an amount of 0.0001-20 AGU/g DS, preferably 0.001-10 AGU/g DS, especially between 0.01-5 AGU/g DS, such as 0.1-2 AGU/g DS.

In an embodiment the glucoamylase is added as a blend further comprising an alpha-amylase. In a preferred embodiment the alpha-amylase is a fungal alpha-amylase, especially an acid fungal alpha-amylase. The alpha-amylase is typically a side activity.

In an embodiment the glucoamylase is a blend comprising *Talaromyces emersonii* glucoamylase disclosed in WO 99/28448 as SEQ ID NO: 7 or SEQ ID NO: 132 herein and *Trametes cingulata* glucoamylase disclosed in WO 06/069289 and SEQ ID NO: 131 herein.

In an embodiment the glucoamylase is a blend comprising *Talaromyces emersonii* glucoamylase disclosed SEQ ID NO: 132, *Trametes cingulata* glucoamylase disclosed as SEQ ID NO: 131, and *Rhizomucor pusillus* alpha-amylase with *Aspergillus niger* glucoamylase linker and SBD disclosed as V039 in Table 5 in WO 2006/069290 and as SEQ ID NO: 136 herein, preferably with the following substitutions: G128D+D143N.

In an embodiment the glucoamylase is a blend comprising *Gloeophyllum sepiarium* glucoamylase shown as SEQ ID NO: 2 in WO 2011/068803 (SEQ ID NO: 134 herein) and *Rhizomucor pusillus* with an *Aspergillus niger* glucoamylase linker and starch-binding domain (SBD), disclosed SEQ ID NO: 3 in WO 2013/006756 (SEQ ID NO: 136 herein) with the following substitutions: G128D+D143N.

In an embodiment the *Rhizomucor pusillus* alpha-amylase or the *Rhizomucor pusillus* alpha-amylase with an *Aspergillus niger* glucoamylase linker and starch-binding domain (SBD) has at least one of the following substitutions or combinations of substitutions: D165M; Y141W; Y141R; K136F; K192R; P224A; P224R; S123H+Y141W; G20S+Y141W; A76G+Y141W; G128D+Y141W; G128D+D143N; P219C+Y141W; N142D+D143N; Y141W+K192R; Y141W+D143N; Y141W+N383R; Y141W+P219C+A265C; Y141W+N142D+D143N; Y141W+K192R V410A; G128D+Y141W+D143N; Y141W+D143N+P219C; Y141W+D143N+K192R; G128D+D143N+K192R; Y141W+D143N+K192R+P219C; G128D+Y141W+D143N+K192R; or G128D+Y141W+D143N+K192R+P219C (using SEQ ID NO: 3 in WO 2013/006756 for numbering).

Commercially available compositions comprising glucoamylase include AMG 200L; AMG 300 L; SAN™ SUPER, SAN™ EXTRA L, SPIRIZYME™ PLUS, SPIRIZYME™ FUEL, SPIRIZYME™ B4U, SPIRIZYME™ ULTRA, SPIRIZYME™ EXCEL, SPIRIZYME ACHIEVE and AMG™ E (from Novozymes A/S); OPTIDEX™ 300, GC480, GC417 (from DuPont-Genencor); AMIGASE™ and AMIGASE™ PLUS (from DSM); G-ZYMEm G900, G-ZYMEm and G990 ZR (from DuPont-Genencor).

Cellulolytic Composition Present and/or Added During Saccharification and/or Fermentation According to the invention a cellulolytic composition is present during fermentation or simultaneous saccharification and fermentation (SSF).

The cellulolytic composition may be any cellulolytic composition, comprising a beta-glucosidase, a cellobiohydrolase and an endoglucanase.

Any cellulase described herein contemplated as being present and/or added during saccharification and/or fermentation is also contemplated for expression by a fermenting organism or host cell.

Examples of suitable cellulolytic composition can be found in WO 2008/151079 and co-pending patent application PCT/US12/052163 published as WO 2013/028928 which are incorporated by reference.

In preferred embodiments the cellulolytic composition is derived from a strain of *Trichoderma*, *Humicola*, or *Chrysosporium*.

In an embodiment the cellulolytic composition is derived from a strain of *Trichoderma reesei*, *Humicola insolens* and/or *Chrysosporium lucknowense*.

In an embodiment the cellulolytic composition comprises a beta-glucosidase, preferably one derived from a strain of the genus *Aspergillus*, such as *Aspergillus oryzae*, such as the one disclosed in WO 2002/095014 or the fusion protein having beta-glucosidase activity disclosed in WO 2008/057637, or *Aspergillus fumigatus*, such as one disclosed in WO 2005/047499 or SEQ ID NO: 27 herein or an *Aspergillus fumigatus* beta-glucosidase variant disclosed in WO 2012/044915 (Novozymes), such as one with the following substitutions F100D, S283G, N456E, F512Y; or a strain of the genus a strain *Penicillium*, such as a strain of the *Penicillium brasilianum* disclosed in WO 2007/019442, or a strain of the genus *Trichoderma*, such as a strain of *Trichoderma reesei*.

In an embodiment the cellulolytic composition comprises a GH61 polypeptide having cellulolytic enhancing activity such as one derived from the genus *Thermoascus*, such as a strain of *Thermoascus aurantiacus*, such as the one described in WO 2005/074656 as SEQ ID NO: 2; or one derived from the genus *Thielavia*, such as a strain of *Thielavia terrestris*, such as the one described in WO 2005/074647 as SEQ ID NO: 7 and SEQ ID NO: 8; or one derived from a strain of *Aspergillus*, such as a strain of *Aspergillus fumigatus*, such as the one described in WO 2010/138754 as SEQ ID NO: 1 and SEQ ID NO: 2; or one derived from a strain derived from *Penicillium*, such as a strain of *Penicillium emersonii*, such as the one disclosed in WO 2011/041397 or SEQ ID NO: 121 herein.

In an embodiment the cellulolytic composition comprises a cellobiohydrolase I (CBH I), such as one derived from a strain of the genus *Aspergillus*, such as a strain of *Aspergillus fumigatus*, such as the Cel7a CBHI disclosed in SEQ ID NO: 2 in WO 2011/057140 or SEQ ID NO: 123 herein, or a strain of the genus *Trichoderma*, such as a strain of *Trichoderma reesei*.

In an embodiment the cellulolytic composition comprises a cellobiohydrolase II (CBH II, such as one derived from a strain of the genus *Aspergillus*, such as a strain of *Aspergillus fumigatus* or SEQ ID NO: 124 herein; or a strain of the genus *Trichoderma*, such as *Trichoderma reesei*, or a strain of the genus *Thielavia*, such as a strain of *Thielavia terrestris*, such as cellobiohydrolase II CEL6A from *Thielavia terrestris*.

In an embodiment the cellulolytic composition comprises a GH61 polypeptide having cellulolytic enhancing activity and a beta-glucosidase.

In an embodiment the cellulolytic composition comprises a GH61 polypeptide having cellulolytic enhancing activity, a beta-glucosidase, and a CBH I.

In an embodiment the cellulolytic composition comprises a GH61 polypeptide having cellulolytic enhancing activity, a beta-glucosidase, a CBH I, and a CBH II.

In an embodiment the cellulolytic composition is a *Trichoderma reesei* cellulolytic enzyme composition, further comprising *Thermoascus aurantiacus* GH61A polypeptide having cellulolytic enhancing activity (SEQ ID NO: 2 in WO 2005/074656), and *Aspergillus oryzae* beta-glucosidase fusion protein (WO 2008/057637).

In an embodiment the cellulolytic composition is a *Trichoderma reesei* cellulolytic enzyme composition, further comprising *Thermoascus aurantiacus* GH61A polypeptide having cellulolytic enhancing activity (SEQ ID NO: 2 in WO 2005/074656) and *Aspergillus fumigatus* beta-glucosidase (SEQ ID NO: 2 of WO 2005/047499) or SEQ ID NO: 122 herein.

In an embodiment the cellulolytic composition is a *Trichoderma reesei* cellulolytic enzyme composition further comprising *Penicillium emersonii* GH61A polypeptide having cellulolytic enhancing activity disclosed in WO 2011/041397 and *Aspergillus fumigatus* beta-glucosidase (SEQ ID NO: 2 of WO 2005/047499) or SEQ ID NO: 122 herein or a variant thereof with the following substitutions F100D, S283G, N456E, F512Y.

In an embodiment, the cellulolytic composition, for example a *Trichoderma reesei* cellulolytic enzyme composition, comprises one or more polypeptides selected from the group consisting of:
  beta-glucosidase;
  cellobiohydrolase I; and
  endoglucanase 1, or a mixture of two or three thereof.

In an embodiment, the cellulolytic composition, for example a *Trichoderma reesei* cellulolytic enzyme composition, comprises one or more of the following components:

(i) an *Aspergillus fumigatus* beta-glucosidase or a variant thereof;
(ii) an *Aspergillus fumigatus* cellobiohydrolase I; and
(iii) a *Trichoderma reesei* endoglucanase 1.

In an embodiment, the cellulolytic composition is a *Trichoderma reesei* cellulolytic composition further comprising:
(i) an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122; (ii) a cellobiohydrolase 1 (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and (iii) an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In a preferred embodiment the cellulolytic composition comprising one or more of the following components:
(i) an *Aspergillus fumigatus* cellobiohydrolase I;
(ii) an *Aspergillus fumigatus* cellobiohydrolase II;
(iii) an *Aspergillus fumigatus* beta-glucosidase or variant thereof; and
(iv) a *Penicillium* sp. GH61 polypeptide having cellulolytic enhancing activity; or homologs thereof.

In an preferred embodiment the cellulolytic composition is derived from *Trichoderma reesei* comprising GH61A polypeptide having cellulolytic enhancing activity derived from a strain of *Penicillium emersonii* (SEQ ID NO: 2 in WO 2011/041397 or SEQ ID NO: 121 herein), *Aspergillus fumigatus* beta-glucosidase (SEQ ID NO: 2 in WO 2005/047499 SEQ ID NO: 27 herein) variant F100D, S283G, N456E, F512Y) disclosed in WO 2012/044915; *Aspergillus fumigatus* Cel7A CBH1 disclosed as SEQ ID NO: 6 in WO2011/057140 (SEQ ID NO: 123 herein) and *Aspergillus fumigatus* CBH II disclosed as SEQ ID NO: 18 in WO 2011/057140 (SEQ ID NO: 124 herein).

In an embodiment the cellulolytic composition is dosed from 0.0001-3 mg EP/g DS, preferably, 0.0005-2 mg EP/g DS, preferably 0.001-1 mg/g DS, more preferably 0.005-0.5 mg EP/g DS, and even more preferably 0.01-0.1 mg EP/g DS.

Enzyme Blends or Compositions

An enzyme blend or composition of the invention comprises at least one polypeptide having beta-1,6-glucanase activity and/or at least one polypeptide having endo- and/or exo-beta-1,3-glucanase activity. In an embodiment, the enzyme blend or composition comprises at least one polypeptide having beta-1,6-glucanase activity and at least one polypeptide having beta-1,3-glucanase activity. In another embodiment, the enzyme blend or composition comprises at least one polypeptide having endo-beta-1,3-glucanase activity and at least one polypeptide having exo-beta-1,3-glucanase activity. In another embodiment, the enzyme blend or composition comprises at least one polypeptide having beta-1,6-glucanase activity, at least one polypeptide having endo-beta-1,3-glucanase activity and at least one polypeptide having exo-beta-1,3-glucanase activity. In another embodiment, the enzyme blend or composition comprises at least one polypeptide having endo-beta-1,3-glucanase activity and/or exo-beta-1,3-glucanase activity. In another embodiment, the enzyme blend or composition comprises at least one polypeptide having beta-1,6-glucanase activity, and/or endo- and/or exo-beta-1,3-glucanase activity.

The beta-glucanases may be selected from preferred GH families and sub-families, e.g., in one embodiment the polypeptide having beta-1,6-glucanase activity is a member of a GH family selected from the group consisting of families GH30, GH5 and GH131, particularly subfamilies GH30_3, GH5_15. In another embodiment, the polypeptide having endo- and/or exo-beta-1,3-glucanase activity is selected from the group consisting of families GH16, GH55, GH64, and GH131, particularly subfamily GH55_3.

The compositions may comprise a polypeptide having beta-glucanase activity (e.g., from the GH5_15, GH16, GH30_3, GH55_3, GH64, or GH131 families), as the major enzymatic component, e.g., a mono-component composition.

In some embodiments, the enzyme blend or composition comprises at least one, at least two, at least three, at least four, or at least five polypeptides having beta-1,6-glucanase activity of the present invention and/or at least one, at least two, at least three, at least four, or at least five polypeptides having exo- and/or endo-beta-1,3-glucanase activity of the present invention.

The enzyme blends or compositions may further comprise additional enzymatic activities, such as one or more (e.g., several) enzymes selected from the group consisting of hydrolase, isomerase, ligase, lyase, oxidoreductase, or transferase, e.g., an alpha-galactosidase, alpha-glucosidase, aminopeptidase, amylase, beta-galactosidase, beta-glucosidase, beta-xylosidase, carbohydrase, carboxypeptidase, catalase, cellobiohydrolase, cellulase, chitinase, cutinase, cyclodextrin glycosyltransferase, deoxyribonuclease, endoglucanase, esterase, glucoamylase, invertase, laccase, lipase, mannosidase, mutanase, oxidase, pectinolytic enzyme, peroxidase, phytase, polyphenoloxidase, proteolytic enzyme, ribonuclease, transglutaminase, trehalase, or xylanase.

In an embodiment, the enzyme blend or composition comprises one or more cellulases, e.g., a beta-glucosidase, a cellobiohydrolase and an endoglucanase.

In another aspect, the present invention relates to a composition comprising a polypeptide having beta-glucanase activity (e.g., beta-1,6-glucanase activity and/or exo- and/or endo-beta-1,3-glucanase activity), and/or a cellulolytic composition, and a recombinant host cell or fermenting organism comprising at least one heterologous polynucleotide (e.g., a recombinant yeast host cell or fermenting organism engineered to optimize production of the fermentation product or a byproduct or co-product of the process for producing the fermentation product). As used in this section, "composition" encompasses process streams within processes for producing a fermentation product, such as ethanol, from a starch-containing material or cellulosic-containing material, such as a fermenting mash or fermented mash composition.

As used herein, "fermenting mash or fermented mash composition" refers to the composition formed by the constituent parts of the mash which are present during fermentation (fermenting mash composition) or after fermentation (fermented mash composition) fermentation, including any compounds (e.g., enzymes) or microorganisms (e.g., fermenting organism, such as a recombinant yeast host cell comprising at least one heterologous polynucleotide) that are exogenously added to a process stream for producing a fermentation product (e.g., enzymes added upstream from the fermentation step, e.g., during the liquefaction step of a conventional process for producing a fermentation product from a starch-containing material, during the pretreatment step of a process for producing a fermentation product from a cellulosic-containing material, or during the saccharification step of any process for producing a fermentation product, such as process for producing a fermentation product from a starch-containing material, a raw starch hydrolysis (RSH) process, and a process for producing a fermentation product from a cellulosic-containing material, chemical inputs (e.g., urea), etc.), and any compounds or microorganisms that are generated in situ in the process stream for producing a fermentation product (e.g., reaction products of enzymes and their substrates in the mash, enzymes secreted from the fermenting organism, etc.).

The at least one heterologous polynucleotide may encode polypeptides that are expressed intracellularly to enhance performance of the yeast or fermenting organism itself, polypeptides that are secreted into the fermenting or fermented mash composition to exert their effects on the mash or components of the mash to improve fermentation results, or both.

In some embodiments, the recombinant yeast host cell or fermenting organism comprises nucleotide sequences encoding the beta-glucanases of the present invention, in addition to at least one other heterologous polynucleotide that optimizes production of the fermentation product or a byproduct or co-product of the process for producing the fermentation product. In other embodiments, the recombinant yeast host cell or fermenting organism comprises nucleotides sequences encoding such at least one heterologous polynucleotide other than the beta-glucanases, such as a fermentation alpha-amylase (e.g., fungal alpha-amylase), carbohydrate-source generating organism (e.g., glucoamylase), and/or protease.

Accordingly, in one aspect, the present invention relates to a composition comprising:

(a) a recombinant yeast host cell or fermenting organism; and
(b) at least one polypeptide having beta-1,6-glucanase activity and/or endo- or exo-beta-1,3-glucanase activity of the present invention,
wherein the yeast host cell or fermenting organism comprises a heterologous polynucleotide encoding a glucoamylase, an alpha-amylase, protease, and/or cellulase.

The present invention contemplates the use of any viable recombinant yeast host cell or fermenting organism in the compositions described herein. Examples of suitable recombinant yeast host cells or fermenting organisms can be found herein in the "Fermenting Organisms" section.

The present invention contemplates the use of any hemicellulase and/or beta-glucanase in the compositions described in this section. Those skilled in the art will appreciate that any of the hemicellulase, beta-glucanase, or enzyme blends described in Section I above, Section IV above, or otherwise described herein, can be used in a composition of the invention.

The present invention contemplates the use of any glucoamylase, alpha-amylase, protease, and/or cellulase. Examples of suitable such enzymes can be found under the heading "Enzymes".

In one embodiment, the composition is a fermenting or fermented mash composition comprising the recombinant yeast host cell or fermenting organism and the at least one hemicellulase and/or at least one beta-glucanase. In another embodiment, the composition is a whole stillage composition comprising the recombinant yeast host cell and the at least one hemicellulase and/or at least one beta-glucanase.

In an embodiment, the fermenting or fermented mash composition or the whole stillage composition comprises:

(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) at least one polypeptide having beta-1,6-glucanase activity and/or at least one polypeptide having exo- and/or endo-beta-1,3-glucanase activity selected from the group consisting of:
(a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity or 100% sequence identity to SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(b) a polypeptide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, which has beta-1,6-glucanase activity and/or endo- and/or exo-beta-1,3-glucanase activity;

(c) a polypeptide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(d) a polypeptide which is encoded by a polynucleotide that hybridizes under medium stringency conditions, medium-high stringency conditions, high stringency conditions, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof, the polypeptide of which has beta-1,6-glucanase activity and/or endo- and/or exo-beta-1,3-glucanase activity;

(e) a polypeptide which is encoded by a polynucleotide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof, the polypeptide of which has beta-1,6-glucanase activity and/or endo- and/or exo-beta-1,3-glucanase activity;

(f) a fragment of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(g) a fragment of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(h) a fragment of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, which has beta-1,6-glucanase activity and/or endo- and/or exo-beta-1,3-glucanase activity;

(i) a variant of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119 comprising a substitution, deletion, and/or insertion at one or more positions, which has beta-1,6-glucanase activity and/or endo- and/or exo-beta-1,3-glucanase activity;

(j) a variant of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119 comprising a substitution, deletion, and/or insertion at one or more positions, which has beta-1,6-glucanase activity and/or endo- and/or exo-beta-1,3-glucanase activity;

(k) a variant of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120 comprising a substitution, deletion, and/or insertion at one or more positions, which has beta-1,6-glucanase activity and/or endo- and/or exo-beta-1,3-glucanase activity (l) a polypeptide comprising, consisting essentially of, or consisting of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119;

(m) a polypeptide comprising, consisting essentially of, or consisting of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120;

(n) a polypeptide comprising, consisting essentially of, or consisting of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119; and (o) a polypeptide comprising SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, and an N-terminal extension and/or C-terminal extension of 1-10 amino acids, e.g., 1, 2, 3, 4, 5, 6, 7, 8, 9, or 10 amino acids.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family and a polypeptide having beta-1,3-glucanase activity from the GH64 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and (ii) a polypeptide having beta-1,6-glucanase activity from the GH5_15 family and a polypeptide having beta-1, 3-glucanase activity from the GH64 family, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, and wherein the polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, or SEQ ID NO: 83.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family and a polypeptide having beta-1, 6-glucanase activity and/or beta-1,3-glucanase activity from the GH131 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family and a polypeptide having beta-1, 3-glucanase activity from the GH64 family, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and wherein the polypeptide having beta-1,6-glucanase activity and/or beta-1,3-glucanase activity from the GH131 family is selected from the group consisting of the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,3-glucanase activity from the GH16 family and a polypeptide having beta-1,3-glucanase activity from the GH55_3 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,3-glucanase activity from the GH16 family and a polypeptide having beta-1,3-glucanase activity from the GH55_3 family, wherein the polypeptide having beta-1,3-glucanase activity from the GH16 family is selected from the group consisting of the mature polypeptide of SEQ ID NO: 20, SEQ ID NO: 23, SEQ ID NO: 26, SEQ ID NO: 29, SEQ ID NO: 86, SEQ ID NO: 89, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 20, SEQ ID NO: 23, SEQ ID NO: 26, SEQ ID NO: 29, SEQ ID NO: 86, or SEQ ID NO: 89, and wherein the polypeptide having beta-1,3-glucanase activity from the GH55_3 family is the mature polypeptide of SEQ ID NO: 5 or SEQ ID NO: 107, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5 or SEQ ID NO: 107.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family and a polypeptide having beta-1,3-glucanase activity from the GH30_3 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family and a polypeptide having beta-1,3-glucanase activity from the GH30_3 family, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104 and wherein the polypeptide having beta-1,3-glucanase activity from the GH30_3 family is selected from the group consisting of the mature polypeptide of SEQ ID NO: 32, SEQ ID NO: 80, SEQ ID NO: 119, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 32, SEQ ID NO: 80, or SEQ ID NO: 119.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family, a polypeptide having beta-1,3-glucanase activity from the GH30_3 family, and a polypeptide having beta-1,3-glucanase activity from the GH16 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family, a polypeptide having beta-1,3-glucanase activity from the GH30_3 family, and a polypeptide having beta-1,3-glucanase activity from the GH16 family, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, wherein the polypeptide having beta-1,3-glucanase activity from the GH30_3 family is selected from the group consisting of the mature polypeptide of SEQ ID NO: 32, SEQ ID NO: 80, SEQ ID NO: 119, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 32, SEQ ID NO: 80, or SEQ ID NO: 119, and wherein the polypeptide having beta-1,3-glucanase activity from the GH16 family is selected from the group consisting of the mature polypeptide of SEQ ID NO: 20, SEQ ID NO: 23, SEQ ID NO: 26, SEQ ID NO: 29, SEQ ID NO: 86, SEQ ID NO: 89, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 20, SEQ ID NO: 23, SEQ ID NO: 26, SEQ ID NO: 29, SEQ ID NO: 86, or SEQ ID NO: 89.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family, a polypeptide having beta-1,3-glucanase activity from the GH64 family, and a polypeptide having beta-1,3-glucanase activity from the GH16 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family, a polypeptide having beta-1,3-glucanase activity from the GH64 family, and a polypeptide having beta-1,3-glucanase activity from the GH16 family, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, wherein the polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, or SEQ ID NO: 83, and wherein polypeptide having beta-1,3-glucanase activity from the GH16 family is selected from the group consisting of the mature polypeptide of SEQ ID NO: 20, SEQ ID NO: 23, SEQ ID NO: 26, SEQ ID NO: 29, SEQ ID NO: 86, SEQ ID NO: 89, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 20, SEQ ID NO: 23, SEQ ID NO: 26, SEQ ID NO: 29, SEQ ID NO: 86, SEQ ID NO: 89.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family and a polypeptide having beta-1,3-glucanase activity from the GH55_3 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family and a polypeptide having beta-1,3-glucanase activity from the GH55_3 family, wherein the polypeptide having beta-1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, wherein the polypeptide having beta-1,3-glucanase activity from the GH55_3 family is the mature polypeptide of SEQ ID NO: 5, SEQ ID NO: 107, SEQ ID NO: 110, SEQ ID NO: 113, SEQ ID NO: 116, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5, SEQ ID NO: 107, SEQ ID NO: 110, SEQ ID NO: 113, or SEQ ID NO: 116.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,3-glucanase activity from the GH55_3 family and a polypeptide having beta-1,3-glucanase activity from the GH64 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,3-glucanase activity from the GH55_3 family and a polypeptide having beta-1,3-glucanase activity from the GH64 family, wherein the polypeptide having beta-1,3-glucanase activity from the GH55_3 family is the mature polypeptide of SEQ ID NO: 5, SEQ ID NO: 107, SEQ ID NO: 110, SEQ ID NO: 113, SEQ ID NO: 116, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5, SEQ ID NO: 107, SEQ ID NO: 110, SEQ ID NO: 113, or SEQ ID NO: 116, and wherein the polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, or SEQ ID NO: 83.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family, a polypeptide having beta-1,3-glucanase activity from the GH55_3 family, and a polypeptide having beta-1,3-glucanase activity from the GH64 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH5_15 family, a polypeptide having beta-1,3-glucanase activity from the GH55_3 family, and a polypeptide having beta-1,3-glucanase activity from the GH64 family, wherein the polypeptide having beta- 1,6-glucanase activity from the GH5_15 family is selected from the group consisting of the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, SEQ ID NO: 104 and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 2, SEQ ID NO: 35, SEQ ID NO: 38, SEQ ID NO: 41, SEQ ID NO: 77, SEQ ID NO: 92, SEQ ID NO: 95, SEQ ID NO: 98, SEQ ID NO: 101, or SEQ ID NO: 104, wherein the polypeptide having beta-1,3-glucanase activity from the GH55_3 family is the mature polypeptide of SEQ ID NO: 5, SEQ ID NO: 107, SEQ ID NO: 110, SEQ ID NO: 113, SEQ ID NO: 116, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5, SEQ ID NO: 107, SEQ ID NO: 110, SEQ ID NO: 113, or SEQ ID NO: 116, and wherein polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, or SEQ ID NO: 83.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,3-glucanase activity from the GH16 family and a polypeptide having beta-1,3-glucanase activity from the GH64 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,3-glucanase activity from the GH16 family and a polypeptide having beta-1,3-glucanase activity from the GH64 family, wherein the polypeptide having beta-1,3-glucanase activity from the GH16 family is selected from the group consisting of the mature polypeptide of SEQ ID NO: 20, SEQ ID NO: 23, SEQ ID NO: 26, SEQ ID NO: 29, SEQ ID NO: 86, SEQ ID NO: 89, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 20, SEQ ID NO: 23, SEQ ID NO: 26, SEQ ID NO: 29, SEQ ID NO: 86, or SEQ ID NO: 89, and wherein the polypeptide having beta-1,3-glucanase activity from the GH64 family is selected from the group consisting of the mature polypeptide of SEQ ID NO: 8, SEQ ID NO: 11, SEQ ID NO: 14, SEQ ID NO: 17, SEQ ID NO: 83, and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8, SEQ ID NO: 11, SEQ ID NO: 14, SEQ ID NO: 17, or SEQ ID NO: 83.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity from the GH131 family and a polypeptide having beta-1,3-glucanase activity from the GH131 family.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase; and (ii) the mature polypeptide of SEQ ID NO: 5 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38.

The fermented or fermenting mash compositions and whole stillage compositions may further comprise a cellulases/cellulolytic composition comprising a beta-glucosidase, a cellobiohydrolase and an endoglucanase. In one embodiment, the cellulases/cellulolytic composition comprises one or more polypeptides selected from the group consisting of:

GH61 polypeptide having cellulolytic enhancing activity;
beta-glucosidase;
Cellobiohydrolase I;
Cellobiohydrolase II;
or a mixture of two, three, or four thereof.

In another embodiment, the cellulases/cellulolytic composition comprises one or more polypeptides selected from the group consisting of:

GH61 polypeptide having cellulolytic enhancing activity;
beta-glucosidase;
Cellobiohydrolase I;
Cellobiohydrolase II;
or a mixture of two, three, or four thereof.

In another embodiment, the cellulases/cellulolytic composition comprises one or more of the following components:

(i) an *Aspergillus fumigatus* cellobiohydrolase I;
(ii) an *Aspergillus fumigatus* cellobiohydrolase II;
(iii) an *Aspergillus fumigatus* beta-glucosidase or variant thereof; and
(iv) a *Penicillium* sp. GH61 polypeptide having cellulolytic enhancing activity; or homologs thereof.

In an embodiment, the fermenting or fermented mash composition or the whole stillage composition comprises:

(i) a recombinant yeast host cell or fermenting organism, wherein the yeast host cell or fermenting organism comprises a heterologous polynucleotide encoding a glucoamylase, an alpha-amylase, protease, and/or cellulase; and (ii) the mature polypeptide of SEQ ID NO: 5 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and (iv) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of

*Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, the fermenting or fermented mash composition or the whole stillage composition comprises:
(ii) a recombinant yeast host cell or fermenting organism, wherein the yeast host cell or fermenting organism comprises a heterologous polynucleotide encoding a glucoamylase, an alpha-amylase, protease, and/or cellulase; and
(ii) the mature polypeptide of SEQ ID NO: 5 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 5;
(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and
(iv) a *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase;
(ii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107; and (iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38.

(iv) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, the fermenting or fermented mash composition or the whole stillage composition comprises:

(i) a recombinant yeast host cell or fermenting organism, wherein the yeast host cell or fermenting organism comprises a heterologous polynucleotide encoding a glucoamylase, an alpha-amylase, protease, and/or cellulase;

(ii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and (iv) a *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124.

In an embodiment, the fermenting or fermented mash composition or the whole stillage composition comprises:
  (i) a recombinant yeast host cell or fermenting organism, wherein the yeast host cell or fermenting organism comprises a heterologous polynucleotide encoding a glucoamylase, an alpha-amylase, protease, and/or cellulase;
  (ii) the mature polypeptide of SEQ ID NO: 8 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8; and
  (iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38.

In an embodiment, the fermenting or fermented mash composition or the whole stillage composition comprises:
  (i) a recombinant yeast host cell or fermenting organism, wherein the yeast host cell or fermenting organism comprises a heterologous polynucleotide encoding a glucoamylase, an alpha-amylase, protease, and/or cellulase;
  (ii) the mature polypeptide of SEQ ID NO: 8 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8;
  (iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and
  (iv) a *Trichoderma reesei* cellulolytic enzyme composition further comprising:
    an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;
    a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase;
(ii) the mature polypeptide of SEQ ID NO: 8 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8;
(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and
(iv) a *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase;

(ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38.

In an embodiment, the fermenting or fermented mash composition or the whole stillage composition comprises:
  (i) a recombinant yeast host cell or fermenting organism, wherein the yeast host cell or fermenting organism comprises a heterologous polynucleotide encoding a glucoamylase, an alpha-amylase, protease, and/or cellulase;
  (ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;
  (iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38;
  (iv) a *Trichoderma reesei* cellulolytic enzyme composition further comprising:
    an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;
    a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and
    an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, the fermenting or fermented mash composition or the whole stillage composition comprises:
  (i) a recombinant yeast host cell or fermenting organism, wherein the yeast host cell or fermenting organism comprises a heterologous polynucleotide encoding a glucoamylase, an alpha-amylase, protease, and/or cellulase;
  (ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and (iv) a *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124.

In an embodiment, the fermenting or fermented mash composition or the whole stillage composition comprises:

(i) a recombinant yeast host cell or fermenting organism, wherein the yeast host cell or fermenting organism comprises a heterologous polynucleotide encoding a glucoamylase, an alpha-amylase, protease, and/or cellulase;

(ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38;

(iv) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125;

(v) a polypeptide having trehalase activity selected from the group consisting of:

a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137 and having trehalase activity; and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 138 and having trehalase activity; and (vi) a glucoamylase blend selected from the group consisting of:

a blend comprising *Gloeophyllum sepiarium* glucoamylase shown as SEQ ID NO: 134, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134, and an alpha-amylase from *Rhizomucor pusillus* with an *Aspergillus niger* glucoamylase linker and starch-binding domain (SBD), disclosed SEQ ID NO: 136 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136; and a blend comprising *Talaromyces emersonii* glucoamylase of SEQ ID NO: 132, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 132, a *Trametes cingulata* glucoamylase of SEQ ID NO: 131, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 131, and a *Rhizomucor pusillus* alpha-amylase with an *Aspergillus niger* glucoamylase linker and starch-binding domain (SBD), of SEQ ID NO: 136, and comprising the following substitutions: G128D+ D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

In an embodiment, the fermenting or fermented mash composition or the whole stillage composition comprises:
  (i) a recombinant yeast host cell or fermenting organism, wherein the yeast host cell or fermenting organism comprises a heterologous polynucleotide encoding a glucoamylase, an alpha-amylase, protease, and/or cellulase;
  (ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11; and
  (iii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107.

In an embodiment, the fermenting or fermented mash composition or the whole stillage composition comprises:
  (i) a recombinant yeast host cell or fermenting organism, wherein the yeast host cell or fermenting organism comprises a heterologous polynucleotide encoding a glucoamylase, an alpha-amylase, protease, and/or cellulase;
  (ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11; and
  (iii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107; and
  (iv) a *Trichoderma reesei* cellulolytic enzyme composition further comprising:
    an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;
    a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and
    an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase;
(ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11; and
(iii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107; and
(iv) a *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase;
(ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11; and
(iii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107;

(iv) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125; and;

(v) a polypeptide having trehalase activity selected from the group consisting of:

a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137 and having trehalase activity; and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 138 and having trehalase activity; and (vi) a glucoamylase blend selected from the group consisting of:

a blend comprising *Gloeophyllum sepiarium* glucoamylase shown as SEQ ID NO: 134, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134, and an alpha-amylase from *Rhizomucor pusillus* with an *Aspergillus niger* glucoamylase linker and starch-binding domain (SBD), disclosed SEQ ID NO: 136 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136; and a blend comprising *Talaromyces emersonii* glucoamylase of SEQ ID NO: 132, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 132, a *Trametes cingulata* glucoamylase of SEQ ID NO: 131, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 131, and a *Rhizomucor pusillus* alpha-amylase with an *Aspergillus niger* glucoamylase linker and starch-binding domain (SBD), of SEQ ID NO: 136, and comprising the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

In an embodiment, the fermenting or fermented mash composition or the whole stillage composition comprises:

(iv) a recombinant yeast host cell or fermenting organism, wherein the yeast host cell or fermenting organism comprises a heterologous polynucleotide encoding a glucoamylase, an alpha-amylase, protease, and/or cellulase;

(v) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and (vi) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107.

In an embodiment, the fermenting or fermented mash composition or the whole stillage composition comprises:

(v) a recombinant yeast host cell or fermenting organism, wherein the yeast host cell or fermenting organism comprises a heterologous polynucleotide encoding a glucoamylase, an alpha-amylase, protease, and/or cellulase;

(vi) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and (vii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107; and (viii) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, the fermenting or fermented mash composition or the whole stillage composition comprises:

(v) a recombinant yeast host cell or fermenting organism, wherein the yeast host cell or fermenting organism comprises a heterologous polynucleotide encoding a glucoamylase, an alpha-amylase, protease, and/or cellulase;

(vi) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and (vii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107; and (viii) a *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124.

In an embodiment, the fermenting or fermented mash composition or the whole stillage composition comprises:
(v) a recombinant yeast host cell or fermenting organism, wherein the yeast host cell or fermenting organism comprises a heterologous polynucleotide encoding a glucoamylase, an alpha-amylase, protease, and/or cellulase;
(vi) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and
(vii) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107;
(viii) a *Trichoderma reesei* cellulolytic enzyme composition further comprising:
an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;
a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and
an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125; and;
(v) a polypeptide having trehalase activity selected from the group consisting of:
a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137 and having trehalase activity; and
a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 138 and having trehalase activity; and
(vii) a glucoamylase blend selected from the group consisting of:
a blend comprising *Gloeophyllum sepiarium* glucoamylase shown as SEQ ID NO: 134, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134, and an alpha-amylase from *Rhizomucor pusillus* with an *Aspergillus niger* glucoamylase linker and starch-binding domain (SBD), disclosed SEQ ID NO: 136 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136; and a blend comprising *Talaromyces emersonii* glucoamylase of SEQ ID NO: 132, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 132, a *Trametes cingulata* glucoamylase of SEQ ID NO: 131, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 131, and a *Rhizomucor pusillus* alpha-amylase with an *Aspergillus niger* glucoamylase linker and starch-binding domain (SBD), of SEQ ID NO: 136, and comprising the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase;
(ii) the mature polypeptide of SEQ ID NO: 8 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8;
(iii) the mature polypeptide of SEQ ID NO: 23 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 23; and
(iv) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38.

In an embodiment, the fermenting or fermented mash composition or the whole stillage composition comprises:
(i) a recombinant yeast host cell or fermenting organism, wherein the yeast host cell or fermenting organism comprises a heterologous polynucleotide encoding a glucoamylase, an alpha-amylase, protease, and/or cellulase;

(ii) the mature polypeptide of SEQ ID NO: 8 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8;

(iii) the mature polypeptide of SEQ ID NO: 23 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 23;

(iv) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and (v) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, the fermenting or fermented mash composition or the whole stillage composition comprises:

(i) a recombinant yeast host cell or fermenting organism, wherein the yeast host cell or fermenting organism comprises a heterologous polynucleotide encoding a glucoamylase, an alpha-amylase, protease, and/or cellulase;

(ii) the mature polypeptide of SEQ ID NO: 8 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 8;

(iii) the mature polypeptide of SEQ ID NO: 23 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 23;

(iv) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38; and (v) a *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*; such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124.

In an embodiment, the fermenting or fermented mash composition or the whole stillage composition comprises:

(i) a recombinant yeast host cell or fermenting organism, wherein the yeast host cell or fermenting organism comprises a heterologous polynucleotide encoding a glucoamylase, an alpha-amylase, protease, and/or cellulase;

(ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38, are present and/or added during saccharification, fermentation, or SSF, or used as a component of an enzyme blend or composition of the invention; and (iv) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107.

In an embodiment, the fermenting or fermented mash composition or the whole stillage composition comprises:

(i) a recombinant yeast host cell or fermenting organism, wherein the yeast host cell or fermenting organism comprises a heterologous polynucleotide encoding a glucoamylase, an alpha-amylase, protease, and/or cellulase;

(ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38, are present and/or added during saccharification, fermentation, or SSF, or used as a component of an enzyme blend or composition of the invention;

(iv) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107; and (v) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

In an embodiment, the fermenting or fermented mash composition or the whole stillage composition comprises:

(i) a recombinant yeast host cell or fermenting organism, wherein the yeast host cell or fermenting organism comprises a heterologous polynucleotide encoding a glucoamylase, an alpha-amylase, protease, and/or cellulase;

(ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38, are present and/or added during saccharification, fermentation, or SSF, or used as a component of an enzyme blend or composition of the invention;

(iv) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107;

(v) a *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121, an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122, a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123, and a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124.

In an embodiment, the fermenting or fermented mash composition or the whole stillage composition comprises:

(i) a recombinant yeast host cell or fermenting organism, wherein the yeast host cell or fermenting organism comprises a heterologous polynucleotide encoding a glucoamylase, an alpha-amylase, protease, and/or cellulase;

(ii) the mature polypeptide of SEQ ID NO: 11 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 11;

(iii) the mature polypeptide of SEQ ID NO: 38 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 38, are present and/or added during saccharification, fermentation, or SSF, or used as a component of an enzyme blend or composition of the invention;

(iv) the mature polypeptide of SEQ ID NO: 107 or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, or at least 99% identity to the mature polypeptide of SEQ ID NO: 107;

(v) a *Trichoderma reesei* cellulolytic enzyme composition further comprising:

an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122;

a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125;

(vi) a polypeptide having trehalase activity selected from the group consisting of:

a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137 and having trehalase activity; and a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 138 and having trehalase activity; and (vii) a glucoamylase blend selected from the group consisting of:

a blend comprising *Gloeophyllum sepiarium* glucoamylase shown as SEQ ID NO: 134, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134, and an alpha-amylase from *Rhizomucor pusillus* with an *Aspergillus niger* glucoamylase linker and starch-binding domain (SBD), disclosed SEQ ID NO: 136 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136; and a blend comprising *Talaromyces emersonii* glucoamylase of SEQ ID NO: 132, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 132, a *Trametes cingulata* glucoamylase of SEQ ID NO: 131, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 131, and a *Rhizomucor pusillus* alpha-amylase with an *Aspergillus niger* glucoamylase linker and starch-binding domain (SBD), of SEQ ID NO: 136, and comprising the following substitutions: G128D+ D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

The compositions may be prepared in accordance with methods known in the art and may be in the form of a liquid or a dry composition. The compositions may be stabilized in accordance with methods known in the art.

The compositions may be used in a process of the invention, for example, for degrading a beta-glucan, such as for example by contacting a beta-glucan with the composition during the saccharification, fermentation, or SSF step of a process of producing a fermentation product (e.g., the production of fuel ethanol from coin).

Other Enzymes

In one embodiment, a beta-glucanase of the invention is combined with one or more enzymes, such as at least two enzymes, more preferred at least three, four or five enzymes. Preferably, the enzymes have different substrate specificity, e.g., proteolytic activity, amylolytic activity, hemicellulytic activity or cellulolytic activity.

The composition may comprise one or more enzymes such as a protease, a glucoamylase, an alpha-amylase, beta-glucosidase, cellobiohydrolase, phytase, endoglucanase, cellulase, trehalase, or xylanase.

In general the properties of the selected enzyme(s) should be compatible with the process conditions, (i.e., pH-optimum, compatibility with other enzymatic and non-enzymatic ingredients, etc.), and the enzyme(s) should be present in effective amounts.

Signal Peptide and Propeptide

The present invention also relates to an isolated polynucleotide encoding a signal peptide comprising or consisting of: amino acids 1 to 17 of SEQ ID NO: 2; amino acids 1 to 17 of SEQ ID NO: 5; amino acids 1 to 16 of SEQ ID NO: 11; amino acids 1 to 16 of SEQ ID NO: 14; amino acids 1 to 15 of SEQ ID NO: 17; amino acids 1 to 19 of SEQ ID NO: 20; amino acids 1 to 19 of SEQ ID NO: 23; amino acids 1 to 19 of SEQ ID NO: 26; amino acids 1 to 19 of SEQ ID NO: 29; amino acids 1 to 18 of SEQ ID NO: 32; amino acids 1 to 17 of SEQ ID NO: 35; amino acids 1 to 16 of SEQ ID NO: 38; amino acids 1 to 17 of SEQ ID NO: 41; amino acids 1 to 18 of SEQ ID NO: 44; amino acids 1 to 16 of SEQ ID NO: 47; amino acids 1 to 16 of SEQ ID NO: 50; amino acids 1 to 18 of SEQ ID NO: 53; amino acids 1 to 21 of SEQ ID NO: 56; amino acids 1 to 19 of SEQ ID NO: 59; amino acids 1 to 17 of SEQ ID NO: 62; amino acids 1 to 18 of SEQ ID NO: 65; amino acids 1 to 19 of SEQ ID NO: 68; amino acids 1 to 18 of SEQ ID NO: 71; amino acids 1 to 16 of SEQ ID NO: 74; amino acids 1 to 17 of SEQ ID NO: 77; amino acids 1 to 16 of SEQ ID NO: 80; amino acids 1 to 19 of SEQ ID NO: 83; amino acids 1 to 19 of SEQ ID NO: 86; amino acids 1 to 19 of SEQ ID NO: 89; amino acids 1 to 19 of SEQ ID NO: 92; amino acids 1 to 17 of SEQ ID NO: 95; amino acids 1 to 17 of SEQ ID NO: 98; amino acids 1 to 17 of SEQ ID NO: 101; amino acids 1 to 17 of SEQ ID NO: 104; amino acids 1 to 17 of SEQ ID NO: 107; amino acids 1 to 19 of SEQ ID NO: 110; amino acids 1 to 22 of SEQ ID NO: 113; amino acids 1 to 16 of SEQ ID NO: 116; amino acids 1 to 18 of SEQ ID NO: 119; amino acids 1 to 19 of SEQ ID NO: 144; amino acids 1 to 19 of SEQ ID NO: 147; amino acids 1 to 18 of SEQ ID NO: 150; or amino acids 1 to 16 of SEQ ID NO: 153.

The present invention also relates to an isolated polynucleotide encoding a propeptide comprising or consisting of amino acids 17 to 64 of SEQ ID NO: 11. In another aspect, the isolated polynucleotide encodes a propeptide comprising or consisting of amino acids 18 to 33 of SEQ ID NO: 107.

The present invention also relates to an isolated polynucleotide encoding a signal peptide and a propeptide comprising or consisting of amino acids 1 to 64 of SEQ ID NO: 11. The polynucleotides may further comprise a gene encoding a protein, which is operably linked to the signal peptide and/or propeptide. The protein is preferably heterologous to the signal peptide and/or propeptide. In one aspect, the polynucleotide encoding the signal peptide is: nucleotides 1 to 51 of SEQ ID NO: 1; nucleotides 1 to 51 of SEQ ID NO: 4; nucleotides 1 to 48 of SEQ ID NO: 10; nucleotides 1 to 48 of SEQ ID NO: 13; nucleotides 1 to 45 of SEQ ID NO: 16; nucleotides 1 to 57 of SEQ ID NO: 19; nucleotides 1 to 57 of SEQ ID NO: 22; nucleotides 1 to 57 of SEQ ID NO: 25; nucleotides 1 to 57 of SEQ ID NO: 28; nucleotides 1 to 54 of SEQ ID NO: 31; nucleotides 1 to 51 of SEQ ID NO: 34; nucleotides 1 to 48 of SEQ ID NO: 37; nucleotides 1 to 51 of SEQ ID NO: 40; nucleotides 1 to 54 of SEQ ID NO: 43; nucleotides 1 to 48 of SEQ ID NO: 46; nucleotides 1 to 48 of SEQ ID NO: 49; nucleotides 1 to 54 of SEQ ID NO: 52; nucleotides 1 to 63 of SEQ ID NO: 55; nucleotides 1 to 57 of SEQ ID NO: 58; nucleotides 1 to 51 of SEQ ID NO: 61; nucleotides 1 to 784 and 839 to 1134 of SEQ ID NO: 64; nucleotides 1 to 57 of SEQ ID NO: 67; nucleotides 1 to 54 of SEQ ID NO: 70; nucleotides 1 to 48 of SEQ ID NO: 73; nucleotides 1 to 51 of SEQ ID NO: 76; nucleotides 1 to 48 of SEQ ID NO: 79; nucleotides 1 to 57 of SEQ ID NO: 82; nucleotides 1 to 57 of SEQ ID NO: 85; nucleotides 1 to 57 of SEQ ID NO: 88; nucleotides 1 to 57 of SEQ ID NO: 91; nucleotides 1 to 51 of SEQ ID NO: 94; nucleotides 1 to 51 of SEQ ID NO: 97; nucleotides 1 to 54 of SEQ ID NO: 100; nucleotides 1 to 57 of SEQ ID NO: 103; nucleotides 1 to 51 of SEQ ID NO: 106; nucleotides 1 to 57 of SEQ ID NO: 109; nucleotides 1 to 66 of SEQ ID NO: 112; nucleotides 1 to 48 of SEQ ID NO: 115; nucleotides 1 to 54 of SEQ ID NO: 118; nucleotides 1 to 57 of SEQ ID NO: 143; nucleotides 1 to 57 of SEQ ID NO: 146; nucleotides 1 to 54 of SEQ ID NO: 149; or nucleotides 1 to 48 of SEQ ID NO: 152.

In another aspect, the polynucleotide encoding the propeptide is nucleotides 49 to 192 of SEQ ID NO: 10. In another aspect, the polynucleotide encoding the signal peptide and the propeptide is nucleotides 1 to 192 of SEQ ID NO: 10.

In another aspect, the polynucleotide encoding the propeptide is nucleotides 18 to 33 of SEQ ID NO: 106.

The present invention also relates to nucleic acid constructs, expression vectors and recombinant host cells comprising such polynucleotides.

The present invention also relates to methods of producing a protein, comprising (a) cultivating a recombinant host cell comprising such polynucleotide; and optionally (b) recovering the protein.

The protein may be native or heterologous to a host cell. The term "protein" is not meant herein to refer to a specific length of the encoded product and, therefore, encompasses peptides, oligopeptides, and polypeptides. The term "protein" also encompasses two or more polypeptides combined to form the encoded product. The proteins also include hybrid polypeptides and fused polypeptides.

Preferably, the protein is a hormone, enzyme, receptor or portion thereof, antibody or portion thereof, or reporter. For example, the protein may be a hydrolase, isomerase, ligase, lyase, oxidoreductase, or transferase, e.g., an alpha-galactosidase, alpha-glucosidase, aminopeptidase, amylase, beta-galactosidase, beta-glucosidase, beta-xylosidase, carbohydrase, carboxypeptidase, catalase, cellobiohydrolase, cellulase, chitinase, cutinase, cyclodextrin glycosyltransferase, deoxyribonuclease, endoglucanase, esterase, glucoamylase, invertase, laccase, lipase, mannosidase, mutanase, oxidase, pectinolytic enzyme, peroxidase, phytase, polyphenoloxidase, proteolytic enzyme, ribonuclease, transglutaminase, or xylanase.

The gene may be obtained from any prokaryotic, eukaryotic, or other source.

The invention is further defined by the following numbered paragraphs:
1. An isolated or purified polypeptide having beta-1,3-glucanase activity, selected from the group consisting of:
    (a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 83, SEQ ID NO: 86, SEQ ID NO: 89, SEQ ID NO: 107, SEQ ID NO: 110, SEQ ID NO: 113, SEQ ID NO: 116, SEQ ID NO: 144, SEQ ID NO: 147, SEQ ID NO: 150 or SEQ ID NO: 153;
    (b) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to the sequence of SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 84, SEQ ID NO: 87, SEQ ID NO: 90, SEQ ID NO: 108, SEQ ID NO: 111, SEQ ID NO: 114, SEQ ID NO: 117, SEQ ID NO: 145, SEQ ID NO: 148, SEQ ID NO: 151, or SEQ ID NO: 154;
    (c) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to a mature polypeptide of SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 83, SEQ ID NO: 86, SEQ ID NO: 89, SEQ ID NO: 107, SEQ ID NO: 110, SEQ ID NO: 113, SEQ ID NO: 116, SEQ ID NO: 144, SEQ ID NO: 147, SEQ ID NO: 150 or SEQ ID NO: 153;
    (d) a polypeptide encoded by a polynucleotide that hybridizes under medium to medium-high stringency conditions with the full-length complement of the mature polypeptide coding sequence of SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 82, SEQ ID NO: 85, SEQ ID NO: 88, SEQ ID NO: 106, SEQ ID NO: 109, SEQ ID NO: 112, SEQ ID NO: 115, SEQ ID NO: 143, SEQ ID NO: 146, SEQ ID NO: 149, or SEQ ID NO: 152, or the cDNA sequence thereof;
    (e) a polypeptide encoded by a polynucleotide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to the mature polypeptide coding sequence of SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 82, SEQ ID NO: 85, SEQ ID NO: 88, SEQ ID NO: 106, SEQ ID NO: 109, SEQ ID NO: 112, SEQ ID NO: 115, SEQ ID NO: 143, SEQ ID NO: 146, SEQ ID NO: 149, or SEQ ID NO: 152, or the cDNA sequence thereof;

(f) a polypeptide derived from a mature polypeptide of SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 83, SEQ ID NO: 86, SEQ ID NO: 89, SEQ ID NO: 107, SEQ ID NO: 110, SEQ ID NO: 113, SEQ ID NO: 116, SEQ ID NO: 144, SEQ ID NO: 147, SEQ ID NO: 150 or SEQ ID NO: 153 by substitution, deletion or addition of one or several amino acids in the mature polypeptide of SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 83, SEQ ID NO: 86, SEQ ID NO: 89, SEQ ID NO: 107, SEQ ID NO: 110, SEQ ID NO: 113, SEQ ID NO: 116, SEQ ID NO: 144, SEQ ID NO: 147, SEQ ID NO: 150 or SEQ ID NO: 153; and (g) a fragment of the polypeptide of (a), (b), (c), (d), (e) or (f) that has beta-1,3-glucanase activity.

2. An isolated or purified polypeptide having beta-1,3-glucanase activity, which is:

(a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 83, SEQ ID NO: 86, SEQ ID NO: 89, SEQ ID NO: 107, SEQ ID NO: 110, SEQ ID NO: 113, SEQ ID NO: 116, SEQ ID NO: 144, SEQ ID NO: 147, SEQ ID NO: 150 or SEQ ID NO: 153; or (b) a fragment of the polypeptide of (a), that has beta-1,3-glucanase activity.

3. An isolated or purified polypeptide having beta-1,3-glucanase activity, which is:

(a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 84, SEQ ID NO: 87, SEQ ID NO: 90, SEQ ID NO: 108, SEQ ID NO: 111, SEQ ID NO: 114, SEQ ID NO: 117, SEQ ID NO: 145, SEQ ID NO: 148, SEQ ID NO: 151, or SEQ ID NO: 154; or (b) a fragment of the polypeptide of (a), that has beta-1,3-glucanase activity.

4. An isolated or purified polypeptide having beta-1,3-glucanase activity, which is:

(a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to a mature polypeptide of SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 83, SEQ ID NO: 86, SEQ ID NO: 89, SEQ ID NO: 107, SEQ ID NO: 110, SEQ ID NO: 113, SEQ ID NO: 116, SEQ ID NO: 144, SEQ ID NO: 147, SEQ ID NO: 150 or SEQ ID NO: 153; or (b) a fragment of the polypeptide of (a), that has beta-1,3-glucanase activity.

5. An isolated or purified polypeptide having beta-1,6-glucanase activity, selected from the group consisting of:

(a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to SEQ ID NO: 2, SEQ ID NO: 32, SEQ ID NO: 35, SEQ ID NO: 38, SEQ ID NO: 41, SEQ ID NO: 77, SEQ ID NO: 80, SEQ ID NO: 92, SEQ ID NO: 95, SEQ ID NO: 98, SEQ ID NO: 101, SEQ ID NO: 104, or SEQ ID NO: 119;

(b) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to the sequence of SEQ ID NO: 3, SEQ ID NO: 33, SEQ ID NO: 36, SEQ ID NO: 39, SEQ ID NO: 42, SEQ ID NO: 78, SEQ ID NO: 81, SEQ ID NO: 93, SEQ ID NO: 96, SEQ ID NO: 99, SEQ ID NO: 102, SEQ ID NO: 105, or SEQ ID NO: 120;

(c) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to a mature polypeptide of SEQ ID NO: 2, SEQ ID NO: 32, SEQ ID NO: 35, SEQ ID NO: 38, SEQ ID NO: 41, SEQ ID NO: 77, SEQ ID NO: 80, SEQ ID NO: 92, SEQ ID NO: 95, SEQ ID NO: 98, SEQ ID NO: 101, SEQ ID NO: 104, or SEQ ID NO: 119;

(d) a polypeptide encoded by a polynucleotide that hybridizes under medium to medium-high stringency conditions with the full-length complement of the mature polypeptide coding sequence of SEQ ID NO: 1, SEQ ID NO: 31, SEQ ID NO: 34, SEQ ID NO: 37, SEQ ID NO: 40, SEQ ID NO: 76, SEQ ID NO: 79, SEQ ID NO: 91, SEQ ID NO: 94, SEQ ID NO: 97, SEQ ID NO: 100, SEQ ID NO: 103, or SEQ ID NO: 118, or the cDNA sequence thereof;

(e) a polypeptide encoded by a polynucleotide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to the mature polypeptide coding sequence of SEQ ID NO: 1, SEQ ID NO: 31, SEQ ID NO: 34, SEQ ID NO: 37, SEQ ID NO: 40, SEQ ID NO: 76, SEQ ID NO: 79, SEQ ID NO: 91, SEQ ID NO: 94, SEQ ID NO: 97, SEQ ID NO: 100, SEQ ID NO: 103, or SEQ ID NO: 118, or the cDNA sequence thereof;

(f) a polypeptide derived from a mature polypeptide of SEQ ID NO: 2, SEQ ID NO: 32, SEQ ID NO: 35, SEQ ID NO: 38, SEQ ID NO: 41, SEQ ID NO: 77, SEQ ID NO: 80, SEQ ID NO: 92, SEQ ID NO: 95, SEQ ID NO: 98, SEQ ID NO: 101, SEQ ID NO: 104, or SEQ ID NO: 119 by substitution, deletion or addition of one or several amino acids in the mature polypeptide of SEQ ID NO: 2, SEQ ID NO: 32, SEQ ID NO: 35, SEQ ID NO: 38, SEQ ID NO: 41, SEQ ID NO: 77, SEQ ID NO: 80, SEQ ID NO: 92, SEQ ID NO: 95, SEQ ID NO: 98, SEQ ID NO: 101, SEQ ID NO: 104, or SEQ ID NO: 119; and (g) a fragment of the polypeptide of (a), (b), (c), (d), (e) or (f) that has beta-1,6-glucanase activity.

6. An isolated or purified polypeptide having beta-1,6-glucanase activity, which is:

(a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to SEQ ID NO: 2, SEQ ID NO: 32, SEQ ID NO: 35, SEQ ID NO: 38, SEQ ID NO: 41, SEQ ID NO: 77, SEQ ID NO: 80, SEQ ID NO: 92, SEQ ID NO: 95, SEQ ID NO: 98, SEQ ID NO: 101, SEQ ID NO: 104, or SEQ ID NO: 119; or (b) a fragment of the polypeptide of (a), that has beta-1,6-glucanase activity.

7. An isolated or purified polypeptide having beta-1,6-glucanase activity, which is:

(a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to SEQ ID NO: 3, SEQ ID NO: 33, SEQ ID NO: 36, SEQ ID NO: 39, SEQ ID NO: 42, SEQ ID NO: 78, SEQ ID NO: 81, SEQ ID NO: 93, SEQ ID NO: 96, SEQ ID NO: 99, SEQ ID NO: 102, SEQ ID NO: 105, or SEQ ID NO: 120; or (b) a fragment of the polypeptide of (a), that has beta-1,6-glucanase activity.

8. An isolated or purified polypeptide having beta-1,6-glucanase activity, which is:

(a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to a mature polypeptide of SEQ ID NO: 2, SEQ ID NO: 32, SEQ ID NO: 35, SEQ ID NO: 38, SEQ ID NO: 41, SEQ ID NO: 77, SEQ ID NO: 80, SEQ ID NO: 92, SEQ ID NO: 95, SEQ ID NO: 98, SEQ ID NO: 101, SEQ ID NO: 104, or SEQ ID NO: 119; or (b) a fragment of the polypeptide of (a), that has beta-1,6-glucanase activity.

9. An isolated or purified polypeptide having beta-1,6-glucanase activity and/or beta-1,3-glucanase activity, selected from the group consisting of:
  (a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74;
  (b) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to the sequence of SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, or SEQ ID NO: 75;
  (c) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to a mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74;
  (d) a polypeptide encoded by a polynucleotide that hybridizes under medium to medium-high stringency conditions with the full-length complement of the mature polypeptide coding sequence of SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, or SEQ ID NO: 73, or the cDNA sequence thereof;
  (e) a polypeptide encoded by a polynucleotide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to the mature polypeptide coding sequence of SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, or SEQ ID NO: 73, or the cDNA sequence thereof;
  (f) a polypeptide derived from a mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74 by substitution, deletion or addition of one or several amino acids in the mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74; and
  (g) a fragment of the polypeptide of (a), (b), (c), (d), (e) or (f) that has beta-1,6-glucanase activity and/or beta-1,3-glucanase activity.

10. An isolated or purified polypeptide having beta-1,6-glucanase activity and/or beta-1,3-glucanase activity, which is:
  (a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74; or
  (b) a fragment of the polypeptide of (a), that has beta-1,6-glucanase activity and/or beta-1,3-glucanase activity.

11. An isolated or purified polypeptide having beta-1,6-glucanase activity and/or beta-1,3-glucanase activity, which is:
  (a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, or SEQ ID NO: 75; or
(b) a fragment of the polypeptide of (a), that has beta-1, 6-glucanase activity and/or beta-1,3-glucanase activity.

12. An isolated or purified polypeptide having beta-1,6-glucanase activity and/or beta-1,3-glucanase activity, which is:
   (a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98%, or at least 99% sequence identity to a mature polypeptide of SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, or SEQ ID NO: 74; or
   (b) a fragment of the polypeptide of (a), that has beta-1, 6-glucanase activity and/or beta-1,3-glucanase activity.

13. An isolated or purified polypeptide having beta-1,3-glucanase activity, which is:
   (i) a fragment of SEQ ID NO: 5 wherein the fragment preferably contains at least 633 amino acid residues (e.g., amino acids 1 to 633 of SEQ ID NO: 5 or SEQ ID NO: 6), at least 671 amino acid residues (e.g., amino acids 1 to 671 of SEQ ID NO: 5 or SEQ ID NO: 6), or at least 707 amino acid residues (e.g., amino acids 1 to 707 of SEQ ID NO: 5 or SEQ ID NO: 6);
   (ii) a fragment of SEQ ID NO: 8 wherein the fragment preferably contains at least 323 amino acid residues (e.g., amino acids 1 to 323 of SEQ ID NO: 8 or SEQ ID NO: 9), at least 342 amino acid residues (e.g., amino acids 1 to 342 of SEQ ID NO: 8 or SEQ ID NO: 9), or at least 361 amino acid residues (e.g., amino acids 1 to 361 of SEQ ID NO: 8 or SEQ ID NO: 9);
   (iii) a fragment of SEQ ID NO: 11 wherein the fragment preferably contains at least 366 amino acid residues (e.g., amino acids 1 to 366 of SEQ ID NO: 11 or SEQ ID NO: 12), at least 388 amino acid residues (e.g., amino acids 1 to 388 of SEQ ID NO: 11 or SEQ ID NO: 12), or at least 409 amino acid residues (e.g., amino acids 1 to 409 of SEQ ID NO: 11 or SEQ ID NO: 12);
   (iv) a fragment of SEQ ID NO: 14 wherein the fragment preferably contains at least 365 amino acid residues (e.g., amino acids 1 to 365 of SEQ ID NO: 14 or SEQ ID NO: 15), at least 386 amino acid residues (e.g., amino acids 1 to 386 of SEQ ID NO: 14 or SEQ ID NO: 15), or at least 408 amino acid residues (e.g., amino acids 1 to 408 of SEQ ID NO: 14 or SEQ ID NO: 15);
   (v) a fragment of SEQ ID NO: 17 wherein the fragment preferably contains at least 363 amino acid residues (e.g., amino acids 1 to 363 of SEQ ID NO: 17 or SEQ ID NO: 18), at least 384 amino acid residues (e.g., amino acids 1 to 384 of SEQ ID NO: 17 or SEQ ID NO: 18), or at least 406 amino acid residues (e.g., amino acids 1 to 406 of SEQ ID NO: 17 or SEQ ID NO: 18);
   (vi) a fragment of SEQ ID NO: 20 wherein the fragment preferably contains at least 224 amino acid residues (e.g., amino acids 1 to 224 of SEQ ID NO: 20 or SEQ ID NO: 21), at least 238 amino acid residues (e.g., amino acids 1 to 238 of SEQ ID NO: 20 or SEQ ID NO: 21), or at least 251 amino acid residues (e.g., amino acids 1 to 251 of SEQ ID NO: 20 or SEQ ID NO: 21);
   (vii) a fragment of SEQ ID NO: 23 wherein the fragment preferably contains at least 228 amino acid residues (e.g., amino acids 1 to 228 of SEQ ID NO: 23 or SEQ ID NO: 24), at least 241 amino acid residues (e.g., amino acids 1 to 241 of SEQ ID NO: 23 or SEQ ID NO: 24), or at least 255 amino acid residues (e.g., amino acids 1 to 255 of SEQ ID NO: 23 or SEQ ID NO: 24);
   (viii) a fragment of SEQ ID NO: 26 wherein the fragment preferably contains at least 226 amino acid residues (e.g., amino acids 1 to 226 of SEQ ID NO: 26 or SEQ ID NO: 27), at least 240 amino acid residues (e.g., amino acids 1 to 240 of SEQ ID NO: 26 or SEQ ID NO: 27), or at least 253 amino acid residues (e.g., amino acids 1 to 253, 7 to 260, 13 to 266 of SEQ ID NO: 26 or SEQ ID NO: 27);
   (ix) a fragment of SEQ ID NO: 29 wherein the fragment preferably contains at least 286 amino acid residues (e.g., amino acids 1 to 286 of SEQ ID NO: 29 or SEQ ID NO: 30), at least 303 amino acid residues (e.g., amino acids 1 to 303 of SEQ ID NO: 29 or SEQ ID NO: 30), or at least 320 amino acid residues (e.g., amino acids 1 to 320 of SEQ ID NO: 29 or SEQ ID NO: 30);
   (x) a fragment of SEQ ID NO: 83 wherein the fragment preferably contains at least 389 amino acid residues (e.g., amino acids 1 to 389 of SEQ ID NO: 83 or SEQ ID NO: 84), at least 412 amino acid residues (e.g., amino acids 1 to 412 of SEQ ID NO: 83 or SEQ ID NO: 84), or at least 435 amino acid residues (e.g., amino acids 1 to 435 of SEQ ID NO: 83 or SEQ ID NO: 84);
   (xi) a fragment of SEQ ID NO: 86 wherein the fragment preferably contains at least 243 amino acid residues (e.g., amino acids 1 to 243 of SEQ ID NO: 86 or SEQ ID NO: 87), at least 257 amino acid residues (e.g., amino acids 1 to 257 of SEQ ID NO: 86 or SEQ ID NO: 87), or at least 271 amino acid residues (e.g., amino acids 1 to 271 of SEQ ID NO: 86 or SEQ ID NO: 87);
   (xii) a fragment of SEQ ID NO: 89 wherein the fragment preferably contains at least 244 amino acid residues (e.g., amino acids 1 to 244 of SEQ ID NO: 89 or SEQ ID NO: 90), at least 258 amino acid residues (e.g., amino acids 1 to 258 of SEQ ID NO: 89 or SEQ ID NO: 90), at least 272 amino acid residues (e.g., amino acids 1 to 272 of SEQ ID NO: 89 or SEQ ID NO: 90);
   (xiii) a fragment of SEQ ID NO: 107 wherein the fragment preferably contains at least 631 amino acid residues (e.g., amino acids 1 to 631 of SEQ ID NO: 107 or SEQ ID NO: 108), at least 668 amino acid residues (e.g., amino acids 1 to 668 of SEQ ID NO: 107 or SEQ ID NO: 108), at least 705 amino acid residues (e.g., amino acids 1 to 705 of SEQ ID NO: 107 or SEQ ID NO: 108);
   (xiv) a fragment of SEQ ID NO: 110 wherein the fragment preferably contains at least 642 amino acid residues (e.g., amino acids 1 to 642 of SEQ ID NO: 110 or SEQ ID NO: 111), at least 680 amino acid residues (e.g., amino acids 1 to 680 of SEQ ID NO: 110 or SEQ ID NO: 111), or at least 718 amino acid residues (e.g., amino acids 1 to 718 of SEQ ID NO: 110 or SEQ ID NO: 111);
   (xv) a fragment of SEQ ID NO: 113 wherein the fragment preferably contains at least 661 amino acid residues (e.g., amino acids 1 to 661 of SEQ ID NO: 113 or SEQ ID NO: 114), at least 700 amino acid residues (e.g., amino acids 1 to 700 of SEQ ID NO: 113 or SEQ ID NO: 114), or at least 739 amino acid residues (e.g., amino acids 1 to 739 of SEQ ID NO: 113 or SEQ ID NO: 114);

(xvi) a fragment of SEQ ID NO: 116 wherein the fragment preferably contains at least 642 amino acid residues (e.g., amino acids 1 to 642 of SEQ ID NO: 116 or SEQ ID NO: 117), at least 680 amino acid residues (e.g., amino acids 1 to 680 of SEQ ID NO: 116 or SEQ ID NO: 117), or at least 718 amino acid residues (e.g., amino acids 1 to 718 of SEQ ID NO: 116 or SEQ ID NO: 117); and wherein the fragment has beta-1,3-glucanase activity.

14. An isolated or purified polypeptide having beta-1,6-glucanase activity, which is:

(i) a fragment of SEQ ID NO: 5 wherein the fragment preferably contains at least 633 amino acid residues (e.g., amino acids 1 to 633 of SEQ ID NO: 5 or SEQ ID NO: 6), at least 671 amino acid residues (e.g., amino acids 1 to 671 of SEQ ID NO: 5 or SEQ ID NO: 6), or at least 707 amino acid residues (e.g., amino acids 1 to 707 of SEQ ID NO: 5 or SEQ ID NO: 6);

(ii) a fragment of SEQ ID NO: 2 wherein the fragment preferably contains at least 350 amino acid residues (e.g., amino acids 1 to 350 of SEQ ID NO: 2 or SEQ ID NO: 3), at least 370 amino acid residues (e.g., amino acids 1 to 370 of SEQ ID NO: 2 or SEQ ID NO: 3), or at least 390 amino acid residues (e.g., amino acids 1 to 390 of SEQ ID NO: 2 or SEQ ID NO: 3).

(iii) a fragment of SEQ ID NO: 32 wherein the fragment preferably contains at least 417 amino acid residues (e.g., amino acids 1 to 417 of SEQ ID NO: 32 or SEQ ID NO: 33), at least 441 amino acid residues (e.g., amino acids 1 to 441 of SEQ ID NO: 32 or SEQ ID NO: 33), or at least 466 amino acid residues (e.g., amino acids 1 to 466 of SEQ ID NO: 32 or SEQ ID NO: 33);

(iv) a fragment of SEQ ID NO: 35 wherein the fragment preferably contains at least 350 amino acid residues (e.g., amino acids 1 to 350 of SEQ ID NO: 35 or SEQ ID NO: 36), at least 370 amino acid residues (e.g., amino acids 1 to 370 of SEQ ID NO: 35 or SEQ ID NO: 36), or at least 390 amino acid residues (e.g., amino acids 1 to 390 of SEQ ID NO: 35 or SEQ ID NO: 36);

(v) a fragment of SEQ ID NO: 38 wherein the fragment preferably contains at least 333 amino acid residues (e.g., amino acids 1 to 333 of SEQ ID NO: 38 or SEQ ID NO: 39), at least 353 amino acid residues (e.g., amino acids 1 to 353 of SEQ ID NO: 38 or SEQ ID NO: 39), or at least 372 amino acid residues (e.g., amino acids 1 to 372 of SEQ ID NO: 38 or SEQ ID NO: 39);

(vi) a fragment of SEQ ID NO: 41 wherein the fragment preferably contains at least 350 amino acid residues (e.g., amino acids 1 to 350 of SEQ ID NO: 41 or SEQ ID NO: 42), at least 370 amino acid residues (e.g., amino acids 1 to 370 of SEQ ID NO: 41 or SEQ ID NO: 42), or at least 390 amino acid residues (e.g., amino acids 1 to 390 of SEQ ID NO: 41 or SEQ ID NO: 42);

(vii) a fragment of SEQ ID NO: 77 wherein the fragment preferably contains at least 366 amino acid residues (e.g., amino acids 1 to 366 of SEQ ID NO: 77 or SEQ ID NO: 78). In some embodiments, a fragment contains at least 388 amino acid residues (e.g., amino acids 1 to 388 of SEQ ID NO: 77 or SEQ ID NO: 78). In some embodiments, a fragment contains at least 409 amino acids residues (e.g., amino acids 1 to 409 of SEQ ID NO: 77 or SEQ ID NO: 78);

(viii) a fragment of SEQ ID NO: 80 wherein the fragment preferably contains at least 414 amino acid residues (e.g., amino acids 1 to 414 of SEQ ID NO: 80 or SEQ ID NO: 81), at least 438 amino acid residues (e.g., amino acids 1 to 438 of SEQ ID NO: 80 or SEQ ID NO: 81), or at least 462 amino acid residues (e.g., amino acids 1 to 462 of SEQ ID NO: 80 or SEQ ID NO: 81);

(ix) a fragment of SEQ ID NO: 92 wherein the fragment preferably contains at least 351 amino acid residues (e.g., amino acids 1 to 351 of SEQ ID NO: 91 or SEQ ID NO: 92), at least 371 amino acid residues (e.g., amino acids 1 to 371 of SEQ ID NO: 91 or SEQ ID NO: 92), or at least 392 amino acid residues (e.g., amino acids 1 to 392 of SEQ ID NO: 91 or SEQ ID NO: 92);

(x) a fragment of SEQ ID NO: 95 wherein the fragment preferably contains at least 364 amino acid residues (e.g., amino acids 1 to 364 of SEQ ID NO: 95 or SEQ ID NO: 96), at least 386 amino acid residues (e.g., amino acids 1 to 386 of SEQ ID NO: 95 or SEQ ID NO: 96), at least 407 amino acid residues (e.g., amino acids 1 to 407 of SEQ ID NO: 95 or SEQ ID NO: 96);

(xi) a fragment of SEQ ID NO: 98 wherein the fragment preferably contains at least 364 amino acid residues (e.g., amino acids 1 to 364 of SEQ ID NO: 98 or SEQ ID NO: 99), at least 386 amino acid residues (e.g., amino acids 1 to 386 of SEQ ID NO: 98 or SEQ ID NO: 99), or at least 407 amino acid residues (e.g., amino acids 1 to 407 of SEQ ID NO: 98 or SEQ ID NO: 99);

(xii) a fragment of SEQ ID NO: 101 wherein the fragment preferably contains at least 364 amino acid residues (e.g., amino acids 1 to 364 of SEQ ID NO: 101 or SEQ ID NO: 102), at least 386 amino acid residues (e.g., amino acids 1 to 386 of SEQ ID NO: 101 or SEQ ID NO: 102), or at least 407 amino acid residues (e.g., amino acids 1 to 407 of SEQ ID NO: 101 or SEQ ID NO: 102);

(xiii) a fragment of SEQ ID NO: 104 wherein the fragment preferably contains at least 364 amino acid residues (e.g., amino acids 1 to 364 of SEQ ID NO: 104 or SEQ ID NO: 105), at least 386 amino acid residues (e.g., amino acids 1 to 386 of SEQ ID NO: 104 or SEQ ID NO: 105), or at least 407 amino acid residues (e.g., amino acids 1 to 407 of SEQ ID NO: 104 or SEQ ID NO: 105); or (xiv) a fragment of SEQ ID NO: 119 wherein the fragment preferably contains at least 417 amino acid residues (e.g., amino acids 1 to 417 of SEQ ID NO: 119 or SEQ ID NO: 120), at least 441 amino acid residues (e.g., amino acids 1 to 441 of SEQ ID NO: 119 or SEQ ID NO: 120), or at least 466 amino acid residues (e.g., amino acids 1 to 466 of SEQ ID NO: 119 or SEQ ID NO: 120); and wherein the fragment has beta-1,6-glucanase activity.

15. An isolated or purified polypeptide having beta-1,6-glucanase activity and/or beta-1,3-glucanase activity, which is (i) a fragment of SEQ ID NO: 44 wherein the fragment preferably contains at least 280 amino acid residues (e.g., amino acids 1 to 280 of SEQ ID NO: 44 or SEQ ID NO: 45), at least 291 amino acid residues (e.g., amino acids 1 to 291 of SEQ ID NO: 44 or SEQ ID NO: 45), or at least 313 amino acid residues (e.g., amino acids 1 to 313 of SEQ ID NO: 44 or SEQ ID NO: 45);

(ii) a fragment of SEQ ID NO: 47 wherein the fragment preferably contains at least 204 amino acid residues (e.g., amino acids 1 to 204 of SEQ ID NO: 47 or SEQ ID NO: 48), at least 216 amino acid residues (e.g., amino acids 1 to 216 of SEQ ID NO: 47 or SEQ ID NO: 48), or at least 228 amino acid residues (e.g., amino acids 1 to 228 of SEQ ID NO: 47 or SEQ ID NO: 48);

(iii) a fragment of SEQ ID NO: 50 wherein the fragment preferably contains at least 216 amino acid residues (e.g., amino acids 1 to 216 of SEQ ID NO: 50 or SEQ ID NO: 51), at least 229 amino acid residues (e.g., amino acids 1 to 254 of SEQ ID NO: 50 or SEQ ID NO: 51), or at least 242 amino acid residues (e.g., amino acids 1 to 242 of SEQ ID NO: 50 or SEQ ID NO: 51);

(iv) a fragment of SEQ ID NO: 53 wherein the fragment preferably contains at least 234 amino acid residues (e.g., amino acids 1 to 234 of SEQ ID NO: 53 or SEQ ID NO: 54), at least 248 amino acid residues (e.g., amino acids 1 to 248 of SEQ ID NO: 53 or SEQ ID NO: 54), or at least 261 amino acid residues (e.g., amino acids 1 to 261 of SEQ ID NO: 53 or SEQ ID NO: 54);

(v) a fragment of SEQ ID NO: 56 wherein the fragment preferably contains at least 224 amino acid residues (e.g., amino acids 1 to 224 of SEQ ID NO: 56 or SEQ ID NO: 57), at least 237 amino acid residues (e.g., amino acids 1 to 237 of SEQ ID NO: 56 or SEQ ID NO: 57), or at least 250 amino acid residues (e.g., amino acids 1 to 250 of SEQ ID NO: 56 or SEQ ID NO: 57);

(vi) a fragment of SEQ ID NO: 59 wherein the fragment preferably contains at least 230 amino acid residues (e.g., amino acids 1 to 230 of SEQ ID NO: 59 or SEQ ID NO: 60), at least 243 amino acid residues (e.g., amino acids 1 to 243 of SEQ ID NO: 59 or SEQ ID NO: 60), or at least 257 amino acid residues (e.g., amino acids 1 to 257 of SEQ ID NO: 59 or SEQ ID NO: 60);

(vii) a fragment of SEQ ID NO: 62 wherein the fragment preferably contains at least 210 amino acid residues (e.g., amino acids 1 to 210 of SEQ ID NO: 62 or SEQ ID NO: 63), at least 222 amino acid residues (e.g., amino acids 1 to 222 of SEQ ID NO: 62 or SEQ ID NO: 63), or at least 235 amino acid residues (e.g., amino acids 1 to 235 of SEQ ID NO: 62 or SEQ ID NO: 63);

(viii) a fragment of SEQ ID NO: 65 wherein the fragment preferably contains at least 290 amino acid residues (e.g., amino acids 1 to 290 of SEQ ID NO: 65 or SEQ ID NO: 66), at least 307 amino acid residues (e.g., amino acids 1 to 307 of SEQ ID NO: 65 or SEQ ID NO: 66), or at least 324 amino acid residues (e.g., amino acids 1 to 324 of SEQ ID NO: 65 or SEQ ID NO: 66);

(ix) a fragment of SEQ ID NO: 68 wherein the fragment preferably contains at least 250 amino acid residues (e.g., amino acids 1 to 250 of SEQ ID NO: 68 or SEQ ID NO: 69), at least 265 amino acid residues (e.g., amino acids 1 to 265 of SEQ ID NO: 68 or SEQ ID NO: 69), or at least 279 amino acid residues (e.g., amino acids 1 to 279 of SEQ ID NO: 68 or SEQ ID NO: 69);

(x) a fragment of SEQ ID NO: 71 wherein the fragment preferably contains at least 230 amino acid residues (e.g., amino acids 1 to 230 of SEQ ID NO: 71 or SEQ ID NO: 72), at least 244 amino acid residues (e.g., amino acids 1 to 244 of SEQ ID NO: 71 or SEQ ID NO: 72), or at least 257 amino acid residues (e.g., amino acids 1 to 257 of SEQ ID NO: 71 or SEQ ID NO: 72); or (xi) a fragment of SEQ ID NO: 74 wherein the fragment preferably contains at least 214 amino acid residues (e.g., amino acids 1 to 214 of SEQ ID NO: 74 or SEQ ID NO: 75), at least 227 amino acid residues (e.g., amino acids 1 to 237 of SEQ ID NO:74 or SEQ ID NO: 75), or at least 239 amino acid residues (e.g., amino acids 1 to 239 of SEQ ID NO: 74 or SEQ ID NO: 75);

wherein the fragment has beta-1,6-glucanase activity and/or beta-1,3-glucanase activity.

16. The polypeptide of any one of paragraphs 1-15, having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119.

17. The polypeptide of any one of paragraphs 1-15, having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120.

18. The polypeptide of any one of paragraphs 1-15, having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to a mature polypeptide of SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119.

19. The polypeptide of any one of paragraphs 1-18, which is encoded by a polynucleotide that hybridizes under medium stringency conditions, medium-high stringency conditions, high stringency conditions, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof.

20. The polypeptide of any one of paragraphs 1-19, which is encoded by a polynucleotide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof.

21. The polypeptide of any one of paragraphs 1-20, which is a fragment of SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, a fragment of a mature polypeptide of SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, or a fragment of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, and wherein the fragment has beta-1,6-glucanase activity and/or beta-1,3-glucanase activity.

22. The polypeptide of any one of paragraphs 1-21, which is a variant of SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, a variant of a mature polypeptide of SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, or a variant of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120 comprising a substitution, deletion, and/or insertion at one or more positions.

23. The polypeptide of any one of paragraphs 1-22, comprising, consisting essentially of, or consisting of SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119.

24. The polypeptide of any one of paragraphs 1-23, comprising, consisting essentially of, or consisting of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120.

25. The polypeptide of any one of paragraphs 1-24, comprising SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO:

117, or SEQ ID NO: 120, and an N-terminal extension and/or C-terminal extension of 1-10 amino acids, e.g., 1, 2, 3, 4, 5, 6, 7, 8, 9, or 10 amino acids.

26. The polypeptide of any one of paragraphs 1-25, which is a mature polypeptide of SEQ ID NO: 2, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119.

27. An isolated or purified polypeptide comprising a catalytic domain selected from the group consisting of:
   (a) a GH5_15 catalytic domain catalyzing beta-1,6-glucanase activity selected from the group consisting of:
      (i) amino acids 21 to 429 of SEQ ID NO: 2 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 2, and which has beta-1,6-glucanase activity;
      (ii) amino acids 17 to 428 of SEQ ID NO: 35 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 17 to 428 of SEQ ID NO: 35, and which has beta-1,6-glucanase activity;
      (iii) amino acids 17 to 408 of SEQ ID NO: 38 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 38, and which has beta-1,6-glucanase activity;
      (iv) amino acids 21 to 429 of SEQ ID NO: 41 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 41, and which has beta-1,6-glucanase activity;
      (v) amino acids 18 to 431 of SEQ ID NO: 77 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 18 to 431 of SEQ ID NO: 77, and which has beta-1,6-glucanase activity;
      (vi) amino acids 20 to 413 of SEQ ID NO: 92 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 413 of SEQ ID NO: 92, and which has beta-1,6-glucanase activity;
      (vii) amino acids 21 to 429 of SEQ ID NO: 95 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 95, and which has beta-1,6-glucanase activity;
      (viii) amino acids 21 to 429 of SEQ ID NO: 98 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 413 of SEQ ID NO: 98, and which has beta-1,6-glucanase activity;
      (ix) amino acids 21 to 429 of SEQ ID NO: 101 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 101, and which has beta-1,6-glucanase activity; or
      (x) amino acids 21 to 429 of SEQ ID NO: 104 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 21 to 429 of SEQ ID NO: 104, and which has beta-1,6-glucanase activity;
   (b) a GH30_3 catalytic domain catalyzing beta-1,6-glucanase activity selected from the group consisting of:
      (i) amino acids 76 to 419 of SEQ ID NO: 32 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 76 to 419 of SEQ ID NO: 32, and which has beta-1,6-glucanase activity;
      (ii) amino acids 74 to 416 of SEQ ID NO: 80 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 74 to 416 of SEQ ID NO: 80, and which has beta-1,6-glucanase activity; and
      (iii) (iii) amino acids 77 to 420 of SEQ ID NO: 119 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 77 to 420 of SEQ ID NO: 119, and which has beta-1,6-glucanase activity;
   (c) a GH55_3 catalytic domain catalyzing exo- and/or endo-beta-1,3-glucanase activity selected from the group consisting of:
      (i) amino acids 34 to 743 of SEQ ID NO: 107 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 34 to 743 of SEQ ID NO: 107, and which has beta-1,3-glucanase activity;
(ii) amino acids 34 to 756 of SEQ ID NO: 110, or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 34 to 756 of SEQ ID NO: 110;
(iv) amino acids 40 to 776 of SEQ ID NO: 113 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 40 to 743 of SEQ ID NO: 113, and which has beta-1,3-glucanase activity; and
(v) amino acids 34 to 756 of SEQ ID NO: 116, or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 34 to 756 of SEQ ID NO: 116;
(d) a GH64 catalytic domain catalyzing exo- and/or endo-beta-1,3-glucanase activity selected from the group consisting of:
(i) amino acids 1 to 380 of SEQ ID NO: 8 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 1 to 380 of SEQ ID NO: 8, and which has exo- and/or endo-beta-1,3-glucanase activity;
(ii) amino acids 64 to 447 of SEQ ID NO: 11 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 64 to 447 of SEQ ID NO: 11, and which has exo- and/or endo-beta-1,3-glucanase activity;
(iii) amino acids 69 to 443 of SEQ ID NO: 14 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 69 to 443 of SEQ ID NO: 14, and which has exo- and/or endo-beta-1,3-glucanase activity;
(iv) amino acids 73 to 440 of SEQ ID NO: 17 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 73 to 440 of SEQ ID NO: 17, and which has exo- and/or endo-beta-1,3-glucanase activity; and
(v) amino acids 20 to 458 of SEQ ID NO: 83 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 458 of SEQ ID NO: 83, and which has exo- and/or endo-beta-1,3-glucanase activity;
(e) a GH16 catalytic domain catalyzing exo- and/or endo-beta-1,3-glucanase activity selected from the group consisting of:
(i) amino acids 26 to 283 of SEQ ID NO: 20 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 26 to 283 of SEQ ID NO: 20, and which has exo- and/or endo-beta-1,3-glucanase activity;
(ii) amino acids 26 to 287 of SEQ ID NO: 23 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 26 to 287 of SEQ ID NO: 23, and which has exo- and/or endo-beta-1,3-glucanase activity;
(iii) amino acids 26 to 285 of SEQ ID NO: 26 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 26 to 285 of SEQ ID NO: 26, and which has exo- and/or endo-beta-1,3-glucanase activity;
(iv) amino acids 34 to 323 of SEQ ID NO: 29 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 34 to 323 of SEQ ID NO: 29, and which has exo- and/or endo-beta-1,3-glucanase activity;
(vi) amino acids 20 to 286 of SEQ ID NO: 86 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 286 of SEQ ID NO: 86, and which has exo- and/or endo-beta-1,3-glucanase activity; and
(vii) amino acids 20 to 284 of SEQ ID NO: 89 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 284 of SEQ ID NO: 89, and which has exo- and/or endo-beta-1,3-glucanase activity;
(f) a GH131 catalytic domain catalyzing beta-1,6-glucanase activity and/or exo- and/or endo-beta-1,3-glucanase activity selected from the group consisting of:
(i) amino acids 19 to 259 of SEQ ID NO: 44 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 19 to 259 of SEQ ID NO: 44, and which has beta-1,6-glucanase activity and/or exo- and/or endo-beta-1,3-glucanase activity;

(ii) amino acids 17 to 251 of SEQ ID NO: 47 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 17 to 251 of SEQ ID NO: 47, and which has beta-1,6-glucanase activity and/or exo- and/or endo-beta-1,3-glucanase activity;

(iii) amino acids 18 to 258 of SEQ ID NO: 50 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 18 to 258 of SEQ ID NO: 50, and which has beta-1,6-glucanase activity and/or exo- and/or endo-beta-1,3-glucanase activity;

(iv) amino acids 38 to 393 of SEQ ID NO: 53 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 38 to 393 of SEQ ID NO: 53, and which has beta-1,6-glucanase activity and/or exo- and/or endo-beta-1,3-glucanase activity;

(v) amino acids 30 to 284 of SEQ ID NO: 56 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 30 to 284 of SEQ ID NO: 56, and which has beta-1,6-glucanase activity and/or exo- and/or endo-beta-1,3-glucanase activity;

(vi) amino acids 36 to 289 of SEQ ID NO: 59 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids amino acids 36 to 289 of SEQ ID NO: 59, and which has beta-1,6-glucanase activity and/or exo- and/or endo-beta-1,3-glucanase activity;

(viii) amino acids 20 to 258 of SEQ ID NO: 62 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 20 to 258 of SEQ ID NO: 62, and which has beta-1,6-glucanase activity and/or exo- and/or endo-beta-1,3-glucanase activity;

(ix) amino acids 22 to 306 of SEQ ID NO: 68 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 22 to 306 of SEQ ID NO: 68, and which has beta-1,6-glucanase activity and/or exo- and/or endo-beta-1,3-glucanase activity;

(x) amino acids 23 to 285 of SEQ ID NO: 71 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 23 to 285 of SEQ ID NO: 71, and which has beta-1,6-glucanase activity and/or exo- and/or endo-beta-1,3-glucanase activity; and (xi) amino acids 17 to 258 of SEQ ID NO: 74 or a polypeptide having at least 60%, e.g., at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to amino acids 17 to 258 of SEQ ID NO: 74, and which has beta-1,6-glucanase activity and/or exo- and/or endo-beta-1,3-glucanase activity; and (g) a fragment of the catalytic domain of (a), (b), (c), (d), (e), or (f) that has beta-1,6-glucanase activity and/or beta-1,3-glucanase activity.

28. The polypeptide of paragraph 27, further comprising a carbohydrate binding module, e.g., a heterologous carbohydrate binding module.

29. The polypeptide of paragraph 27 or 28, wherein the catalytic domain has at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to amino acids 21 to 429 of SEQ ID NO: 2; amino acids 17 to 428 of SEQ ID NO: 35; amino acids 17 to 408 of SEQ ID NO: 38; amino acids 21 to 429 of SEQ ID NO: 41; amino acids 18 to 431 of SEQ ID NO: 77; amino acids 20 to 413 of SEQ ID NO: 92, and which has beta-1,6-glucanase activity; amino acids 21 to 429 of SEQ ID NO: 95; amino acids 21 to 429 of SEQ ID NO: 98; amino acids 21 to 429 of SEQ ID NO: 101; amino acids 21 to 429 of SEQ ID NO: 104; amino acids 76 to 419 of SEQ ID NO: 32; amino acids 74 to 416 of SEQ ID NO: 80; amino acids 77 to 420 of SEQ ID NO: 119; amino acids 34 to 743 of SEQ ID NO: 107; amino acids 34 to 756 of SEQ ID NO: 110; amino acids 40 to 776 of SEQ ID NO: 113; amino acids 34 to 756 of SEQ ID NO: 116; amino acids 1 to 380 of SEQ ID NO: 8; amino acids 64 to 447 of SEQ ID NO:11; amino acids 69 to 443 of SEQ ID NO: 14; amino acids 73 to 440 of SEQ ID NO: 17; amino acids 20 to 458 of SEQ ID NO: 83; amino acids 26 to 283 of SEQ ID NO: 20; amino acids 26 to 287 of SEQ ID NO: 23; amino acids 26 to 285 of SEQ ID NO: 26; amino acids 34 to 323 of SEQ ID NO: 29; amino acids 20 to 286 of SEQ ID NO: 86; amino acids 20 to 284 of SEQ ID NO: 89; amino acids 19 to 259 of SEQ ID NO: 44; amino acids 17 to 251 of SEQ ID NO: 47; amino acids 18 to 258 of SEQ ID NO: 50; amino acids 38 to 393 of SEQ ID NO: 53; amino acids 30 to 284 of SEQ ID NO: 56; amino acids 36 to 289 of SEQ ID NO: 59; amino acids 20 to 258 of SEQ ID NO: 62; amino acids 22 to 306 of SEQ ID NO: 68; amino acids 23 to 285 of SEQ ID NO: 71; or amino acids 17 to 258 of SEQ ID NO: 74.

30. The polypeptide of any one of paragraphs 18-29, wherein the catalytic domain comprises, consists essentially of, or consists amino acids 21 to 429 of SEQ ID NO: 2; amino acids 17 to 428 of SEQ ID NO: 35; amino acids 17 to 408 of SEQ ID NO: 38; amino acids 21 to 429 of SEQ ID NO: 41; amino acids 18 to 431 of SEQ ID NO: 77; amino acids 20 to 413 of SEQ ID NO: 92, and which has beta-1, 6-glucanase activity; amino acids 21 to 429 of SEQ ID NO: 95; amino acids 21 to 429 of SEQ ID NO: 98; amino acids 21 to 429 of SEQ ID NO: 101; amino acids 21 to 429 of SEQ ID NO: 104; amino acids 76 to 419 of SEQ ID NO: 32; amino acids 74 to 416 of SEQ ID NO: 80; amino acids 77 to 420 of SEQ ID NO: 119; amino acids 34 to 743 of SEQ ID NO: 107; amino acids 34 to 756 of SEQ ID NO: 110; amino acids 40 to 776 of SEQ ID NO: 113; amino acids 34 to 756 of SEQ ID NO: 116; amino acids 1 to 380 of SEQ ID NO: 8; amino acids 64 to 447 of SEQ ID NO:11; amino acids 69 to 443 of SEQ ID NO: 14; amino acids 73 to 440 of SEQ ID NO: 17; amino acids 20 to 458 of SEQ ID NO: 83; amino acids 26 to 283 of SEQ ID NO: 20; amino acids 26 to 287 of SEQ ID NO: 23; amino acids 26 to 285 of SEQ ID NO: 26; amino acids 34 to 323 of SEQ ID NO: 29; amino acids 20 to 286 of SEQ ID NO: 86; amino acids 20 to 284 of SEQ ID NO: 89; amino acids 19 to 259 of SEQ ID NO: 44; amino acids 17 to 251 of SEQ ID NO: 47; amino acids 18 to 258 of SEQ ID NO: 50; amino acids 38 to 393 of SEQ ID NO: 53; amino acids 30 to 284 of SEQ ID NO: 56; amino acids 36 to 289 of SEQ ID NO: 59; amino acids 20 to 258 of SEQ ID NO: 62; amino acids 22 to 306 of SEQ ID NO: 68; amino acids 23 to 285 of SEQ ID NO: 71; or amino acids 17 to 258 of SEQ ID NO: 74.

31. The polypeptide of any one of paragraphs 18-30, wherein the catalytic domain is a variant of amino acids 21 to 429 of SEQ ID NO: 2; amino acids 17 to 428 of SEQ ID NO: 35; amino acids 17 to 408 of SEQ ID NO: 38; amino acids 21 to 429 of SEQ ID NO: 41; amino acids 18 to 431 of SEQ ID NO: 77; amino acids 20 to 413 of SEQ ID NO: 92, and which has beta-1,6-glucanase activity; amino acids 21 to 429 of SEQ ID NO: 95; amino acids 21 to 429 of SEQ ID NO: 98; amino acids 21 to 429 of SEQ ID NO: 101; amino acids 21 to 429 of SEQ ID NO: 104; amino acids 76 to 419 of SEQ ID NO: 32; amino acids 74 to 416 of SEQ ID NO: 80; amino acids 77 to 420 of SEQ ID NO: 119; amino acids 34 to 743 of SEQ ID NO: 107; amino acids 34 to 756 of SEQ ID NO: 110; amino acids 40 to 776 of SEQ ID NO: 113; amino acids 34 to 756 of SEQ ID NO: 116; amino acids 1 to 380 of SEQ ID NO: 8; amino acids 64 to 447 of SEQ ID NO:11; amino acids 69 to 443 of SEQ ID NO: 14; amino acids 73 to 440 of SEQ ID NO: 17; amino acids 20 to 458 of SEQ ID NO: 83; amino acids 26 to 283 of SEQ ID NO: 20; amino acids 26 to 287 of SEQ ID NO: 23; amino acids 26 to 285 of SEQ ID NO: 26; amino acids 34 to 323 of SEQ ID NO: 29; amino acids 20 to 286 of SEQ ID NO: 86; amino acids 20 to 284 of SEQ ID NO: 89; amino acids 19 to 259 of SEQ ID NO: 44; amino acids 17 to 251 of SEQ ID NO: 47; amino acids 18 to 258 of SEQ ID NO: 50; amino acids 38 to 393 of SEQ ID NO: 53; amino acids 30 to 284 of SEQ ID NO: 56; amino acids 36 to 289 of SEQ ID NO: 59; amino acids 20 to 258 of SEQ ID NO: 62; amino acids 22 to 306 of SEQ ID NO: 68; amino acids 23 to 285 of SEQ ID NO: 71; or amino acids 17 to 258 of SEQ ID NO: 74 comprising a substitution, deletion, and/or insertion at one or more positions.

32. The polypeptide of any one of paragraphs 18-31, wherein the catalytic domain is a fragment of amino acids 21 to 429 of SEQ ID NO: 2; amino acids 17 to 428 of SEQ ID NO: 35; amino acids 17 to 408 of SEQ ID NO: 38; amino acids 21 to 429 of SEQ ID NO: 41; amino acids 18 to 431 of SEQ ID NO: 77; amino acids 20 to 413 of SEQ ID NO: 92, and which has beta-1,6-glucanase activity; amino acids 21 to 429 of SEQ ID NO: 95; amino acids 21 to 429 of SEQ ID NO: 98; amino acids 21 to 429 of SEQ ID NO: 101; amino acids 21 to 429 of SEQ ID NO: 104; amino acids 76 to 419 of SEQ ID NO: 32; amino acids 74 to 416 of SEQ ID NO: 80; amino acids 77 to 420 of SEQ ID NO: 119; amino acids 34 to 743 of SEQ ID NO: 107; amino acids 34 to 756 of SEQ ID NO: 110; amino acids 40 to 776 of SEQ ID NO: 113; amino acids 34 to 756 of SEQ ID NO: 116; amino acids 1 to 380 of SEQ ID NO: 8; amino acids 64 to 447 of SEQ ID NO:11; amino acids 69 to 443 of SEQ ID NO: 14; amino acids 73 to 440 of SEQ ID NO: 17; amino acids 20 to 458 of SEQ ID NO: 83; amino acids 26 to 283 of SEQ ID NO: 20; amino acids 26 to 287 of SEQ ID NO: 23; amino acids 26 to 285 of SEQ ID NO: 26; amino acids 34 to 323 of SEQ ID NO: 29; amino acids 20 to 286 of SEQ ID NO: 86; amino acids 20 to 284 of SEQ ID NO: 89; amino acids 19 to 259 of SEQ ID NO: 44; amino acids 17 to 251 of SEQ ID NO: 47; amino acids 18 to 258 of SEQ ID NO: 50; amino acids 38 to 393 of SEQ ID NO: 53; amino acids 30 to 284 of SEQ ID NO: 56; amino acids 36 to 289 of SEQ ID NO: 59; amino acids 20 to 258 of SEQ ID NO: 62; amino acids 22 to 306 of SEQ ID NO: 68; amino acids 23 to 285 of SEQ ID NO: 71; or amino acids 17 to 258 of SEQ ID NO: 74, and wherein the fragment has beta-1,6-glucanase and/or beta-1,3-glucanase activity.

33. An isolated or purified polypeptide comprising a carbohydrate binding module and a catalytic domain, wherein the binding module is selected from the group consisting of:
 (a) a carbohydrate binding module having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to amino acids 311 to 347 of SEQ ID NO: 44 or SEQ ID NO: 45, or amino acids 323 to 359 of SEQ ID NO: 65 or SEQ ID NO: 66;
 (b) a carbohydrate binding module encoded by a polynucleotide that hybridizes under medium, medium-high, or high stringency conditions with the full-length complement of nucleotides 1068 to 1178 of SEQ ID NO: 43 or the cDNA sequence thereof, or with the full-length complement of nucleotides 1021 to 1128 of SEQ ID NO: 64 or the cDNA sequence thereof;
 (c) a carbohydrate binding module encoded by a polynucleotide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to nucleotides 1068 to 1178 of SEQ ID NO: 43 or the cDNA sequence thereof, or with the full-length complement of nucleotides 1021 to 1128 of SEQ ID NO: 64 or the cDNA sequence thereof;
 (d) a carbohydrate binding module derived from amino acids 311 to 346 of SEQ ID NO: 44 or amino acids 311 to 346 of SEQ ID NO: 45 by substitution, deletion or addition of one or several amino acids in the amino acids 311 to 346 of SEQ ID NO: 44 or amino acids 311 to 346 of SEQ ID NO: 45, or derived from amino acids 323 to 359 of SEQ ID NO: 65 or amino acids 323 to 359 of SEQ ID NO: 66 by substitution, deletion or addition of one or several amino acids in the amino acids 323 to 359 of SEQ ID NO: 65 or amino acids 323 to 359 of SEQ ID NO: 66; and (e) a fragment of (a), (b), (c) or (d), that has carbohydrate binding activity.

34. The polypeptide of paragraph 33, wherein the catalytic domain is obtained from a hydrolase, isomerase, ligase, lyase, oxidoreductase, or transferase, e.g., an aminopeptidase, amylase, carbohydrase, carboxypeptidase, catalase, cellobiohydrolase, cellulase, chitinase, cutinase, cyclodextrin glycosyltransferase, deoxyribonuclease, endoglucanase, esterase, alpha-galactosidase, beta-galactosidase, glucoamylase, alpha-glucosidase, beta-glucosidase, invertase, laccase, lipase, mannosidase, mutanase, oxidase, pectinolytic enzyme, peroxidase, phytase, polyphenoloxidase, proteolytic enzyme, ribonuclease, transglutaminase, xylanase, or beta-xylosidase.

35. The polypeptide of paragraph 33 or 34, wherein the carbohydrate binding module has at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to amino acids 311 to 347 of SEQ ID NO: 44 or SEQ ID NO: 45, or amino acids 323 to 359 of SEQ ID NO: 65 or SEQ ID NO: 66.

36. The polypeptide of any one of paragraphs 33-35, wherein the carbohydrate binding module is encoded by a polynucleotide that hybridizes under medium stringency conditions, medium-high stringency conditions, high stringency conditions, or very high stringency conditions with the full-length complement of nucleotides 1068 to 1178 of SEQ ID NO: 43 or the cDNA sequence thereof, or with the full-length complement of nucleotides 1021 to 1128 of SEQ ID NO: 64 or the cDNA thereof.

37. The polypeptide of any one of paragraphs 33-36, wherein the carbohydrate binding module is encoded by a polynucleotide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to nucleotides 1068 to 1178 of SEQ ID NO: 43 or the cDNA sequence thereof, or with the full-length complement of nucleotides 1021 to 1128 of SEQ ID NO: 64.

38. The polypeptide of any one of paragraphs 33-37, wherein the carbohydrate binding module comprises, consists essentially of, or consists of amino acids 311 to 347 of SEQ ID NO: 44 or SEQ ID NO: 45, or amino acids 323 to 359 of SEQ ID NO: 65 or SEQ ID NO: 66.

39. The polypeptide of any one of paragraphs 33-38, wherein the carbohydrate binding module is a variant of amino acids 311 to 347 of SEQ ID NO: 44 or SEQ ID NO: 45, or a variant of amino acids 323 to 359 of SEQ ID NO: 65 or SEQ ID NO: 66 comprising a substitution, deletion, and/or insertion at one or more positions.

40. The polypeptide of any one of paragraphs 33-39, wherein the carbohydrate binding module is a fragment of amino acids 311 to 347 of SEQ ID NO: 44 or SEQ ID NO: 45, or a fragment of amino acids amino acids 323 to 359 of SEQ ID NO: 65 or SEQ ID NO: 66, wherein the fragment has carbohydrate binding module activity.

41. A fusion polypeptide comprising the polypeptide of any one of paragraphs 1-40 and a second polypeptide.

42. A granule, which comprises:
(a) a core comprising the polypeptide of any one of paragraphs 1-41, and optionally,
(b) a coating consisting of one or more layer(s) surrounding the core.

43. A granule, which comprises:
(a) a core, and
(b) a coating consisting of one or more layer(s) surrounding the core, wherein the coating comprises the polypeptide of any one of paragraphs 1-41.

44. A composition comprising the polypeptide of any one of paragraphs 1-41 or the granule of paragraph 42 or 43.

45. A whole broth formulation or cell culture composition comprising the polypeptide of any one of paragraphs 1-41.

46. An isolated or purified polynucleotide encoding the polypeptide of any one of paragraphs 1-41.

47. The polynucleotide of paragraph 46, which comprises nucleotides 1 to 1290 of SEQ ID NO: 1; nucleotides 1 to 2289 of SEQ ID NO: 4; nucleotides 1 to 1143 of SEQ ID NO: 7; nucleotides 1 to 1344 of SEQ ID NO: 10; nucleotides 1 to 1344 of SEQ ID NO: 10; nucleotides 1 to 1338 of SEQ ID NO: 13; nucleotides 1 to 1329 of SEQ ID NO: 16; nucleotides 1 to 771 and 830 to 910 of SEQ ID NO: 19, or the cDNA sequence thereof; nucleotides 1 to 864 of SEQ ID NO: 22; nucleotides 1 to 777 and 839 to 919 of SEQ ID NO: 25, or the cDNA sequence thereof; nucleotides 1 to 1071 of SEQ ID NO: 28; nucleotides 1 to 868 and 931 to 1535 of SEQ ID NO: 31, or the cDNA sequence thereof; nucleotides 1 to 1290 of SEQ ID NO: 34; nucleotides 1 to 73, 132 to 583, 645 to 914 and 998 to 1429 of SEQ ID NO: 37, or the cDNA sequence thereof; nucleotides 1 to 175 and 234 to 1348 of SEQ ID NO: 40, or the cDNA sequence thereof; nucleotides 1 to 145, 213 to 851 and 852 to 921 of SEQ ID NO: 43, or the cDNA sequence thereof; nucleotides 1 to 109, 161 to 297, 343 to 507 and 556 to 915 of SEQ ID NO: 46, or the cDNA sequence thereof; nucleotides 1 to 552, 625 to 847 and 911 to 948 of SEQ ID NO: 49, or the cDNA sequence thereof; nucleotides 1 to 653 and 713 to 941 of SEQ ID NO: 52, or the cDNA sequence thereof; nucleotides 1 to 435, 486 to 676 and 727 to 955 of SEQ ID NO: 55, or the cDNA sequence thereof; nucleotides 1 to 453, 559 to 746 and 888 to 1116 of SEQ ID NO: 58, or the cDNA sequence thereof; nucleotides 1 to 112, 183 to 319, 390 to 554 and 609 to 989 of SEQ ID NO: 61, or the cDNA sequence thereof; nucleotides 1 to 784 and 839 to 1134 of SEQ ID NO: 64, or the cDNA sequence thereof; nucleotides 1 to 137, 193 to 223, 28 to 610, 667 to 941 and 998 to 1165 of SEQ ID NO: 67, or the cDNA sequence thereof; nucleotides 1 to 160, 213 to 262, 311 to 720, and 773 to 1022 of SEQ ID NO: 70, or the cDNA sequence thereof; nucleotides 1 to 552, 691 to 913 and 996 to 1027 of SEQ ID NO: 73, or the cDNA sequence thereof; nucleotides 1 to 165 and 228 to 1348 of SEQ ID NO: 76, or the cDNA sequence thereof; nucleotides 1 to 862 and 919 to 1520 of SEQ ID NO: 79, or the cDNA sequence thereof; nucleotides 1 to 1377 of SEQ ID NO: 82; nucleotides 1 to 780 and 837 to 917 of SEQ ID NO: 85, or the cDNA sequence thereof; nucleotides 1 to 771 and 830 to 913 of SEQ ID NO: 88, or the cDNA sequence thereof; nucleotides 1 to 175 and 237 to 1351 of SEQ ID NO: 94, or the cDNA sequence thereof; nucleotides 1 to 175 and 234 to 1348 of SEQ ID NO: 97, or the cDNA sequence thereof; nucleotides 1 to 175 and 234 to 1348 of SEQ ID NO: 100, or the cDNA sequence thereof; nucleotides 1 to 175 and 237 to 1351 of SEQ ID NO: 103, or the cDNA sequence thereof; nucleotides 1 to 294, 349 to 2164, and 2219 to 2391 of SEQ ID NO: 106; nucleotides 58 to 2101 and 2155 to 2324 of SEQ ID NO: 109, or the cDNA sequence thereof; nucleotides 67 to 2337 of SEQ ID NO: 112; nucleotides 49 to 2101 and 2155 to 2324 of SEQ ID NO: 115, or the cDNA sequence thereof; nucleotides 55 to 871 and 947 to 1551 of SEQ ID NO: 119, or the cDNA sequence thereof.

48. A nucleic acid construct or expression vector comprising the polynucleotide of paragraph 46 or 47, wherein the polynucleotide is operably linked to one or more control sequences that direct the production of the polypeptide in an expression host.

49. A recombinant host cell comprising the polynucleotide of paragraph 46 or 47 operably linked to one or more control sequences that direct the production of the polypeptide.

50. The recombinant host cell of paragraph 49, wherein the polypeptide is heterologous to the recombinant host cell.

51. The recombinant host cell of paragraph 49 or 50, wherein at least one of the one or more control sequences is heterologous to the polynucleotide encoding the polypeptide.

52. The recombinant host cell of any one of paragraphs 49 to 51, which comprises at least two copies, e.g., three, four, or five, of the polynucleotide of paragraph 46 or 47.

53. The recombinant host cell of any one of paragraphs 49-52, which is a yeast recombinant host cell, e.g., a *Candida*, *Hansenula*, *Kluyveromyces*, *Pichia*, *Saccharomyces*, *Schizosaccharomyces*, or *Yarrowia* cell, such as a *Kluyveromyces* lactis, *Saccharomyces carlsbergensis*, *Saccharomyces cerevisiae*, *Saccharomyces diastaticus*, *Saccharomyces douglasii*, *Saccharomyces kluyven*, *Saccharomyces norbensis*, *Saccharomyces oviformis*, or *Yarrowia lipolytica* cell.

54. The recombinant host cell of any one of paragraphs 49-52, which is a filamentous fungal recombinant host cell, e.g., an *Acremonium*, *Aspergillus*, *Aureobasidium*, *Bjerkandera*, *Ceriporiopsis*, *Chrysosporium*, *Coprinus*, *Coriolus*, *Cryptococcus*, *Filibasidium*, *Fusarium*, *Humicola*, *Magnaporthe*, *Mucor*, *Myceliophthora*, *Neocallimastix*, *Neurospora*, *Paecilomyces*, *Penicillium*, *Phanerochaete*, *Phiebia*, *Piromyces*, *Pleurotus*, *Schizophyllum*, *Talaromyces*, *Thermoascus*, *Thielavia*, *Tolypocladium*, *Trametes*, or *Trichoderma* cell, in particular, an *Aspergillus awamori*, *Aspergillus foetidus*, *Aspergillus fumigatus*, *Aspergillus japonicus*, *Aspergillus nidulans*, *Aspergillus niger*, *Aspergillus oryzae*, *Bjerkandera adusta*, *Ceriporiopsis aneirina*, *Cenponopsis caregiea*, *Ceriponopsis gilvescens*, *Cenponopsis pannocinta*, *Cenponopsis rivulosa*, *Ceriponopsis subrufa*, *Cenponopsis subvermispora*, *Chrysosponum inops*, *Chrysosporium keratinophilum*, *Chrysosporium lucknowense*, *Chrysosporium merdarium*, *Chrysosponum pannicola*, *Chrysosponum queenslandicum*, *Chrysosponum tropicum*, *Chrysosporium zonatum*, *Coprinus cinereus*, *Coriolus hirsutus*, *Fusarium bactidioides*, *Fusarium cerealis*, *Fusarium crookwellense*, *Fusanum culmorum*, *Fusanum graminearum*, *Fusanum graminum*, *Fusanum heterosporum*, *Fusanum negundi*, *Fusarium oxysporum*, *Fusanum reticulatum*, *Fusarium roseum*, *Fusarium sambucinum*, *Fusarium sarcochroum*, *Fusarium sporotrichioides*, *Fusarium suiphureum*, *Fusarium torulosum*, *Fusarium tichothecioides*, *Fusarium venenatum*, *Humicola insolens*, *Humicola lanuginosa*, *Mucor miehei*, *Myceliophthora thermophila*, *Neurospora crassa*, *Penicillium purpurogenum*, *Phanerochaete chrysosponum*, *Phiebia radiata*, *Pleurotus eryngii*, *Talaromyces emersonii*, *Thielavia terrestris*, *Trametes villosa*, *Trametes versicolor*, *Trichoderma harzianum*, *Trichoderma koningii*, *Trichoderma longibrachiatum*, *Trichoderma reesei*, or *Trichoderma viride* cell.

55. The recombinant host cell of any one of paragraphs 49-52, which is a prokaryotic recombinant host cell, e.g., a Gram-positive cell selected from the group consisting of *Bacillus*, *Clostindium*, *Enterococcus*, *Geobacillus*, *Lactobacillus*, *Lactococcus*, *Oceanobacillus*, *Staphylococcus*, *Streptococcus*, or *Streptomyces* cells, or a Gram-negative bacteria selected from the group consisting of *Campylobacter*, *E. coli*, *Flavobacterium*, *Fusobacterium*, *Helicobacter*, *Ilyobacter*, *Neisseria*, *Pseudomonas*, *Salmonella*, and *Ureaplasma* cells, such as *Bacillus alkalophilus*, *Bacillus amyloliquefaciens*, *Bacillus brews*, *Bacillus circulans*, *Bacillus clausii*, *Bacillus coagulans*, *Bacillus firmus*, *Bacillus lautus*, *Bacillus lentus*, *Bacillus licheniformis*, *Bacillus megaterium*, *Bacillus pumilus*, *Bacillus stearothermophilus*, *Bacillus subtilis*, *Bacillus thuringiensis*, *Streptococcus equisimilis*, *Streptococcus pyogenes*, *Streptococcus uberis*, and *Streptococcus equi* subsp. *Zooepidemicus*, *Streptomyces achromogenes*, *Streptomyces avermitilis*, *Streptomyces coelicolor*, *Streptomyces griseus*, and *Streptomyces lividans* cells.

56. A method of producing the polypeptide of any one of paragraphs 1-41, comprising cultivating a cell, which in its wild-type form produces the polypeptide, under conditions conducive for production of the polypeptide.

57. The method of paragraph 56, further comprising recovering the polypeptide.

58. A method of producing a polypeptide having beta-1,6-glucanase activity and/or beta-1,3-glucanase activity, comprising cultivating the recombinant host cell of any one of paragraphs 49-55 under conditions conducive for production of the polypeptide.

59. The method of paragraph 58, further comprising recovering the polypeptide.

60. An isolated or purified polynucleotide encoding a signal peptide comprising or consisting of amino acids 1 to 17 of SEQ ID NO: 2; amino acids 1 to 17 of SEQ ID NO: 5; amino acids 1 to 16 of SEQ ID NO: 11; amino acids 1 to 16 of SEQ ID NO: 14; amino acids 1 to 15 of SEQ ID NO: 17; amino acids 1 to 19 of SEQ ID NO: 20; amino acids 1 to 19 of SEQ ID NO: 23; amino acids 1 to 19 of SEQ ID NO: 26; amino acids 1 to 19 of SEQ ID NO: 29; amino acids 1 to 18 of SEQ ID NO: 32; amino acids 1 to 17 of SEQ ID NO: 35; amino acids 1 to 16 of SEQ ID NO: 38; amino acids 1 to 17 of SEQ ID NO: 41; amino acids 1 to 18 of SEQ ID NO: 44; amino acids 1 to 16 of SEQ ID NO: 47; amino acids 1 to 16 of SEQ ID NO: 50; amino acids 1 to 18 of SEQ ID NO: 53; amino acids 1 to 21 of SEQ ID NO: 56; amino acids 1 to 19 of SEQ ID NO: 59; amino acids 1 to 17 of SEQ ID NO: 62; amino acids 1 to 18 of SEQ ID NO: 65; amino acids 1 to 19 of SEQ ID NO: 68; amino acids 1 to 18 of SEQ ID NO: 71; amino acids 1 to 16 of SEQ ID NO: 74; amino acids 1 to 17 of SEQ ID NO: 77; amino acids 1 to 16 of SEQ ID NO: 80; amino acids 1 to 19 of SEQ ID NO: 83; amino acids 1 to 19 of SEQ ID NO: 86; amino acids 1 to 19 of SEQ ID NO: 89; amino acids 1 to 19 of SEQ ID NO: 92; amino acids 1 to 17 of SEQ ID NO: 95; amino acids 1 to 17 of SEQ ID NO: 98; amino acids 1 to 17 of SEQ ID NO: 101; amino acids 1 to 17 of SEQ ID NO: 104; amino acids 1 to 17 of SEQ ID NO: 107; amino acids 1 to 19 of SEQ ID NO: 110; amino acids 1 to 22 of SEQ ID NO: 113; amino acids 1 to 16 of SEQ ID NO: 116; or amino acids 1 to 18 of SEQ ID NO: 119, which is operably linked to a polynucleotide encoding a polypeptide which is heterologous to the signal peptide.

61. The polynucleotide of paragraph 61, further comprising a polynucleotide encoding a propeptide comprising or consisting of amino acids 1 to 17 of SEQ ID NO: 2; amino acids 1 to 17 of SEQ ID NO: 5; amino acids 1 to 16 of SEQ ID NO: 11; amino acids 1 to 16 of SEQ ID NO: 14; amino acids 1 to 15 of SEQ ID NO: 17; amino acids 1 to 19 of SEQ ID NO: 20; amino acids 1 to 19 of SEQ ID NO: 23; amino acids 1 to 19 of SEQ ID NO: 26; amino acids 1 to 19 of SEQ ID NO: 29; amino acids 1 to 18 of SEQ ID NO: 32; amino acids 1 to 17 of SEQ ID NO: 35; amino acids 1 to 16 of SEQ ID NO: 38; amino acids 1 to 17 of SEQ ID NO: 41; amino acids 1 to 18 of SEQ ID NO: 44; amino acids 1 to 16 of SEQ ID NO: 47; amino acids 1 to 16 of SEQ ID NO: 50; amino acids 1 to 18 of SEQ ID NO: 53; amino acids 1 to 21 of SEQ ID NO: 56; amino acids 1 to 19 of SEQ ID NO: 59; amino acids 1 to 17 of SEQ ID NO: 62; amino acids 1 to 18 of SEQ ID NO: 65; amino acids 1 to 19 of SEQ ID NO: 68; amino acids 1 to 18 of SEQ ID NO: 71; amino acids 1 to 16 of SEQ ID NO: 74; amino acids 1 to 17 of SEQ ID NO: 77; amino acids 1 to 16 of SEQ ID NO: 80; amino acids 1 to 19 of SEQ ID NO: 83; amino acids 1 to 19 of SEQ ID NO: 86; amino acids 1 to 19 of SEQ ID NO: 89; amino acids 1 to 19 of SEQ ID NO: 92; amino acids 1 to 17 of SEQ ID NO: 95; amino acids 1 to 17 of SEQ ID NO: 98; amino acids 1 to 17 of SEQ ID NO: 101; amino acids 1 to 17 of SEQ ID NO: 104; amino acids 1 to 17 of SEQ ID NO: 107; amino acids 1 to 19 of SEQ ID NO: 110; amino acids 1 to 22 of SEQ ID NO: 113; amino acids 1 to 16 of SEQ ID NO: 116; or amino acids 1 to 18 of SEQ ID NO: 119.

62. A nucleic acid construct or expression vector comprising the polynucleotide of paragraph 60 or 61.

63. A recombinant host cell comprising a nucleic acid construct or expression vector of paragraph 62.

64. A method of producing a protein, comprising cultivating the recombinant host cell of paragraph 63 under conditions conducive for production of the protein.

65. The method of paragraph 64, further comprising recovering the protein.

66. An isolated or purified polynucleotide encoding a propeptide comprising or consisting of amino acids 17 to 64 of SEQ ID NO: 11 or amino acids 18 to 33 of SEQ ID NO: 107, which is operably linked to a polynucleotide encoding a polypeptide which is heterologous to the propeptide.

67. A nucleic acid construct or expression vector comprising a gene encoding a protein operably linked to the polynucleotide of paragraph 66, wherein the gene is heterologous to the polynucleotide encoding the propeptide.

68. A recombinant host cell comprising a nucleic acid construct or expression vector of paragraph 67.

69. A method of producing a protein, comprising cultivating the recombinant host cell of paragraph 68 under conditions conducive for production of the protein.

70. The method of paragraph 69, further comprising recovering the protein.

71. A process for producing fermentation products from starch-containing material comprising the steps of:
  i) saccharifying the starch-containing material using a carbohydrate-source generating enzyme at a temperature below the initial gelatination temperature;
  ii) ii) fermenting using a fermenting organism;
  wherein at least one polypeptide having beta-1,6-glucanase activity and/or at least one polypeptide having endo- and/or exo-beta-1,3-glucanase activity are present or added during saccharifying step ii) or fermenting step iii).

72. A process for producing fermentation products from starch-containing material comprising the steps of:
  i) liquefying the starch-containing material at a temperature above the initial gelatinization temperature using an alpha-amylase;
  ii) saccharifying using a carbohydrate-source generating enzyme;
  iii) fermenting using a fermenting organism;
  wherein at least one polypeptide having beta-1,6-glucanase activity and/or at least one polypeptide having endo- and/or exo-beta-1,3-glucanase activity are present or added during saccharifying step ii) or fermenting step iii).

73. A process for producing fermentation products from cellulosic-containing material comprising the steps of:
  i) optionally pretreating a cellulosic-containing material;
  ii) saccharifying a cellulosic-containing material and/or pretreated cellulosic-containing material using a carbohydrate-source generating enzyme; and
  iii) fermenting using a fermenting organism;
  wherein at least one polypeptide having beta-1,6-glucanase activity and/or at least one polypeptide having endo- and/or exo-beta-1,3-glucanase activity are present or added during saccharifying step ii) or fermentating step iii).

74. The process of any one of paragraphs 71-73, wherein saccharifying step ii) and fermenting step iii) are performed simultaneously in a simultaneous saccharification and fermentation.

75. The process of any one of paragraphs 71-74, wherein at least one polypeptide having beta-1,6-glucanase activity and at least one polypeptide having beta-1,3-glucanase activity are present or added during fermentation or simultaneous saccharification and fermentation.

76. The process of any one of paragraphs 71-75, wherein at least one polypeptide having endo-beta-1,3-glucanase activity and at least one polypeptide having exo-beta-1,3-glucanase activity are present or added during fermentation or simultaneous saccharification and fermentation.

77. The process of any one of paragraphs 71-76, wherein the polypeptide having beta-1,6-glucanase activity is a member of a glycoside hydrolase (GH) family selected from the group consisting of families GH30, GH5, and GH131, particularly subfamilies GH30_3 and GH5_15.

78. The process of any one of paragraphs 71-77, wherein the polypeptide having beta-1,3-glucanase activity is a member of a glycoside hydrolase (GH) family selected from the group consisting of families GH16, GH55, GH64 and GH131, particularly subfamily GH55_3.

79. The process of any one of paragraphs 71-78, wherein the at least one polypeptide having beta-1,6-glucanase activity and the at least one polypeptide having beta-1,3-glucanase activity is selected from the combinations:
  i) GH5_15 and GH64;
  ii) GH5_15 and GH30_3 and GH16;
  iii) GH5_15 and GH64 and GH16;
  iv) GH5_15 and GH55_3;
  v) GH55_3 and GH64;
  vi) GH5_15 and GH55_3 and GH64;
  vii) GH5_15 and GH131;
  viii) GH16 and GH64;
  ix) G5_15 and GH30_3;
  x) GH16 and GH55_3; and
  xi) GH131 and GH131.

80. The process of any one of paragraphs 71-79, wherein the at least one polypeptide having beta-1,6-glucanase activity and/or at least one polypeptide having endo- and/or exo-beta-1,3-glucanase activity is selected from the group consisting of:
  (a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity or 100% sequence identity to SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(b) a polypeptide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, which has beta-1,6-glucanase activity and/or endo- and/or exo-beta-1,3-glucanase activity;

(c) a polypeptide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(d) a polypeptide which is encoded by a polynucleotide that hybridizes under medium stringency conditions, medium-high stringency conditions, high stringency conditions, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof, the polypeptide of which has beta-1,6-glucanase activity and/or endo- and/or exo-beta-1,3-glucanase activity;

(e) a polypeptide which is encoded by a polynucleotide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof, the polypeptide of which has beta-1,6-glucanase activity and/or endo- and/or exo-beta-1,3-glucanase activity;

(f) a fragment of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(g) a fragment of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(h) a fragment of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, which has beta-1,6-glucanase activity and/or endo- and/or exo-beta-1,3-glucanase activity;

(i) a variant of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119 comprising a substitution, deletion, and/or insertion at one or more positions, which has beta-1,6-glucanase activity and/or endo- and/or exo-beta-1,3-glucanase activity;

(j) a variant of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119 comprising a substitution, deletion, and/or insertion at one or more positions, which has beta-1,6-glucanase activity and/or endo- and/or exo-beta-1,3-glucanase activity;

(k) a variant of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120 comprising a substitution, deletion, and/or insertion at one or more positions, which has beta-1,6-glucanase activity and/or endo- and/or exo-beta-1,3-glucanase activity (l) a polypeptide comprising, consisting essentially of, or consisting of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119;

(m) a polypeptide comprising, consisting essentially of, or consisting of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120;

(n) a polypeptide comprising, consisting essentially of, or consisting of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119; and (o) a polypeptide comprising SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, and an N-terminal extension and/or C-terminal extension of 1-10 amino acids, e.g., 1, 2, 3, 4, 5, 6, 7, 8, 9, or 10 amino acids.

81. The process of any one of paragraphs 71-80, wherein the at least one polypeptide having beta-1,6-glucanase activity and/or endo- and/or exo-beta-1,3-glucanase activity comprises at least one, at least two, at least three, at least four, or at least five polypeptides having beta-1,6-glucanase activity and/or endo- and/or exo-beta-1,3-glucanase activity.

82. The process of any one of paragraphs 71-81, wherein the at least one polypeptide having beta-1,6-glucanase activity and the at least one polypeptide having beta-1,3-glucanase activity is present/added in a ratio based on beta-1,6-glucanase activity to beta-1,3-glucanase activity of 1:10; 1:5; 1:2.5; 1:2; 1:1.5:1:1; 1:0.9; 1:0.8; 1:0.7; 1:0.6; 1:0.5; 1:0.4; 1:0.3; 1:0.2.

83. The process of any one of paragraphs 71-82, wherein the at least one polypeptide having beta-1,6-glucanase activity and/or the at least one polypeptide having beta-1,3-glucanase activity are dosed in the range 0.1-1000 micro gram EP/g DS; 0.5-500 micro gram EP/g DS; 1-100 micro gram EP/g DS; such as 5-50 micro gram EP/g DS.

84. The process of any one of paragraphs 71-83, wherein saccharification is performed in the presence of at least one cellulase/cellulolytic composition.

85. The process of paragraph 84, wherein the cellulases/cellulolytic composition are derived from a strain of *Trichoderma*, in particular *Trichoderma reesei*, or a strain of *Humicola*, in particular *Humicola insolens*, or a strain of *Chrysosporium*, in particular *Chrysosporium lucknowense*.

86. The process of paragraphs 84 or 85, wherein the cellulases/cellulolytic composition comprises a beta-glucosidase, a cellobiohydrolase and an endoglucanase.

87. The process of any one of paragraphs 84-86, wherein the cellulases/cellulolytic composition comprises one or more polypeptides selected from the group consisting of:
  beta-glucosidase;
  cellobiohydrolase I; and
  endoglucanase I, or a mixture of two or three thereof.

88. The process of any one of paragraphs 84-87, wherein the cellulases/cellulolytic composition comprises one or more of the following components:
  (i) an *Aspergillus fumigatus* beta-glucosidase or a variant thereof;
  (ii) an *Aspergillus fumigatus* cellobiohydrolase I; and
  (iii) a *Trichoderma reesei* endoglucanase 1.

89. The process of any one of paragraphs 84-88, wherein the cellulases/cellulolytic composition is a *Trichoderma reesei* cellulolytic composition further comprising:
  (i) an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122; (ii) a cellobiohydrolase I (CBH I), such as one derived from a strain of the genus *Aspergillus*, such as a strain of *Aspergillus fumigatus*, such as the CBHI disclosed as SEQ ID NO: 123, or a CBHI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123; and
  (iii) an endoglucanase I (EGI), such as one derived from a strain of the genus *Trichoderma*, such as a strain of *Trichoderma reesei*, such as the EGI disclosed as SEQ ID NO: 125, or an EGI having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 125.

90. The process of any one of paragraphs 84-89, wherein the cellulases/cellulolytic composition comprises a beta-glucosidase, a cellobiohydrolase and an endoglucanase.

91. The process of any one of paragraphs 84-90, wherein the cellulases/cellulolytic composition comprises one or more polypeptides selected from the group consisting of:
  GH61 polypeptide having cellulolytic enhancing activity;
  beta-glucosidase;
  Cellobiohydrolase I;
  Cellobiohydrolase II;
  or a mixture of two, three, or four thereof.

92. The process of any one of paragraphs 84-91, wherein the cellulases/cellulolytic composition comprises one or more polypeptides selected from the group consisting of:
  GH61 polypeptide having cellulolytic enhancing activity;
  beta-glucosidase;
  Cellobiohydrolase I;
  Cellobiohydrolase II;
  or a mixture of two, three, or four thereof.

93. The process of any one of paragraphs 84-92, wherein the cellulases/cellulolytic composition comprises one or more of the following components:
  (i) an *Aspergillus fumigatus* cellobiohydrolase I;
  (ii) an *Aspergillus fumigatus* cellobiohydrolase II;
  (iii) an *Aspergillus fumigatus* beta-glucosidase or variant thereof; and
  (iv) a *Penicillium* sp. GH61 polypeptide having cellulolytic enhancing activity; or homologs thereof.

94. The process of any one of paragraphs 84-93, wherein the cellulases/cellulolytic composition is a *Trichoderma reesei* cellulolytic enzyme composition further comprising *Penicillium emersonii* GH61A polypeptide having cellulolytic enhancing activity disclosed in SEQ ID NO: 121, or a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 121 and an *Aspergillus fumigatus* beta-glucosidase disclosed in SEQ ID NO: 122 or a variant thereof with the following substitutions: F100D, S283G, N456E, F512Y having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 122.

95. The process of any one of paragraphs 84-94, wherein the cellulolytic composition comprises a cellobiohydrolase I (CBH I), such as one derived from a strain of the genus *Aspergillus*, such as a strain of *Aspergillus fumigatus*, such as the CBHI disclosed as SEQ ID NO: 123, or CBH I having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 123.

96. The process of any one of paragraphs 84-95, wherein the cellulolytic composition comprises a cellobiohydrolase II (CBH II), such as one derived from a strain of the genus *Aspergillus*, such as a strain of *Aspergillus fumigatus*; such as the CBH II disclosed as SEQ ID NO: 124, or a CBH II having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 124.

97. The process of any one of paragraphs 71-96, wherein liquefaction is performed in the presence of a protease having a thermostability value of more than 20% determined as Relative Activity at 80° C./70° C.

98. The process of any one of paragraphs 71-97, wherein liquefaction is performed in the presence of a glucoamylase.

99. The process of any one of paragraphs 71-98, wherein the carbohydrate-source generating enzyme(s) is at least a glucoamylase and optionally in combination with a fungal acid alpha-amylase.

100. The process of any one of paragraphs 71-99, wherein the fermentation product is an alcohol, preferably ethanol, especially fuel ethanol, potable ethanol and/or industrial ethanol.

101. The process of any one of paragraphs 71-100, wherein the alpha-amylase is a bacterial or fungal alpha-amylase.

102. The process of any one of paragraphs 71-101, wherein the alpha-amylase is from the genus *Bacillus*, such as a strain of *Bacillus stearothermophilus*, in particular a variant of a *Bacillus stearothermophilus* alpha-amylase, such as the one shown in SEQ ID NO: 126, or alpha-amylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 126.

103. The process of any one of paragraphs 71-102, wherein the *Bacillus stearothermophilus* alpha-amylase comprises a deletion of two amino acids in the region corresponding to positions 179-182 using SEQ ID NO: 126 for numbering.

104. The process of paragraph 103, wherein the deletion is selected from the group consisting of 179*+180*, 179*+181*, 179*+182*, 180*+181*, 180*+182*, and 181*+182*, particularly I181*+G182*.

105. The process of any one of paragraphs 102-104, wherein the alpha-amylase comprises a substitution N193F using SEQ ID NO: 126 for numbering.

106. The process of any one of paragraphs 102-105 wherein the *Bacillus stearothermophilus* alpha-amylase has a substitution in position S242, preferably S242Q substitution using SEQ ID NO: 126 for numbering.

107. The process of any one of paragraphs 102-106, wherein the *Bacillus stearothermophilus* alpha-amylase has a substitution in position E188, preferably E188P substitution using SEQ ID NO: 126 for numbering.

108. The process of any one of paragraphs 71-107, wherein the alpha-amylase has a T½ (min) at pH 4.5, 85° C., 0.12 mM $CaCl_2$) of at least 10, such as at least 15, such as at least 20, such as at least 25, such as at least 30, such as at least 40, such as at least 50, such as at least 60, such as between 10-70, such as between 15-70, such as between 20-70, such as between 25-70, such as between 30-70, such as between 40-70, such as between 50-70, such as between 60-70.

109. The process of any one of paragraphs 71-108, wherein the alpha-amylase is selected from the following group of *Bacillus stearothermophilus* alpha-amylase variants (using SEQ ID NO: 126 for numbering):

I181*+G182*+N193F+E129V+K177L+R179E;
I181*+G182*+N193F+V59A+Q89R+E129V+K177L+R179E+H208Y+K220P+N224L+Q254S
I181*+G182*+N193F+V59A+Q89R+E129V+K177L+R179E+Q254S+M284V;
I181*+G182*+N193F+V59A+E129V+K177L+R179E+Q254S+M284V;
I181*+G182*+N193F+E129V+K177L+R179E+K220P+N224L+S242Q+Q254S;
I181*+G182*+V59A+E129V+K177L+R179E+Q254S+M284V+V212T+Y268G+N293Y+T297N;
I181*+G182*+V59A+E129V+K177L+R179E+Q254S+M284V+V212T+Y268G+N293Y+T297N+S173N+E188P+H208Y+S242Y+K2791;
I181*+G182*+V59A+E129V+K177L+R179S+Q254S+M284V+V212T+Y268G+N293Y+T297N+A184Q+E188P+T191N

I181*+G182*+V59A+E129V+K177L+R179S+Q254S+ M284V+V212T+Y268G+N293Y+T297N+A184Q+ E188P+T191N+S242Y+K279I;

I181*+G182*+V59A+E129V+K177L+R179E+Q254S+ M284V+V212T+Y268G+N293Y+T297N+E188P+ K279W;

I181*+G182*+V59A+E129V+K177L+R179E+Q254S+ M284V+V212T+Y268G+N293Y+T297N+W115D+ D117Q+T133P;

and wherein the variant has at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 126.

110. The process of any one of paragraphs 71-109, wherein a protease with a thermostability value of more than 25% determined as Relative Activity at 80° C./70° C. is present in liquefaction step i).

111. The process of any one of paragraphs 71-110, the protease has a thermostability of more than 30%, more than 40%, more than 50%, more than 60%, more than 70%, more than 80%, more than 90%, more than 100%, such as more than 105%, such as more than 110%, such as more than 115%, such as more than 120% determined as Relative Activity at 80° C./70° C.

112. The process of anyone of paragraphs 71-111, wherein the alpha-amylase has a T½ (min) at pH 4.5, 85° C., 0.12 mM $CaCl_2$) of at least 10, such as at least 15, such as at least 20, such as at least 25, such as at least 30, such as at least 40, such as at least 50, such as at least 60, such as between 10-70, such as between 15-70, such as between 20-70, such as between 25-70, such as between 30-70, such as between 40-70, such as between 50-70, such as between 60-70.

113. The process of anyone of paragraphs 71-112, wherein the protease has a thermostability of between 20% and 50%, such as between 20% and 40%, such as 20% and 30% determined as Relative Activity at 80° C./70° C.

114. The process of anyone of paragraphs 71-113, wherein the protease has a thermostability between 50% and 115%, such as between 50% and 70%, such as between 50% and 60%, such as between 100% and 120%, such as between 105% and 115% determined as Relative Activity at 80° C./70° C.

115. The process of anyone of paragraphs 71-114, wherein the protease has a thermostability of more than 10%, such as more than 12%, more than 14%, more than 16%, more than 18%, more than 20%, more than 30%, more than 40%, more that 50%, more than 60%, more than 70%, more than 80%, more than 90%, more than 100%, more than 110% determined as Relative Activity at 85° C./70° C.

116. The process of any one of paragraphs 71-115, wherein the protease has thermostability of between 10% and 50%, such as between 10% and 30%, such as between 10% and 25% determined as Relative Activity at 85° C./70° C.

117. The process of anyone of paragraphs 71-116, wherein the protease has a thermostability above 60%, such as above 90%, such as above 100%, such as above 110% at 85° C. as determined using the Zein-BCA assay.

118. The process of anyone of paragraphs 71-117, wherein the protease has a thermostability between 60-120, such as between 70-120%, such as between 80-120%, such as between 90-120%, such as between 100-120%, such as 110-120% at 85° C. as determined using the Zein-BCA assay.

119. The process of any one of paragraphs 71-118, wherein the protease is of fungal or bacterial origin.

120. The process of any one of paragraphs 71-119, wherein the protease is a metallo protease or a serine protease.

121. The process of any one of paragraphs 71-120, wherein the protease is a variant of the metallo protease derived from a strain of the genus *Thermoascus*, preferably a strain of *Thermoascus aurantiacus*, especially *Thermoascus aurantiacus* CGMCC No. 0670.

122. The process of any one of paragraphs 71-121, wherein the protease is a variant of the metallo protease disclosed as SEQ ID NO: 127 with the following mutations:
D79L+S87P+A112P+D142L;
D79L+S87P+D142L; or
A27K+D79L+Y82F+S87G+D104P+A112P+A126V+ D142L; and
wherein the protease has at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 127.

123. The process of any one of paragraphs 71-122, wherein the protease is a serine protease, particularly an S8 serine protease derived from a strain of *Pyrococcus*, preferably a strain of *Pyrococcus furiosus*, or derived from a strain of *Thermococcus*, preferably *Themococcus thioreducens* or *Thermococcus nautili*, or derived from a strain of *Palaeococcus*, preferably *Palaeococcus ferrophilus*

124. The process of any one of paragraphs 71-123, wherein the protease is derived from a strain of *Pyrococcus*, preferably a strain of *Pyrococcus furiosus*.

125. The process of any one of paragraphs 71-124, wherein the protease is the one shown in SEQ ID NO: 128, or a protease having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 128.

126. The process of any one of paragraphs 71-125, wherein the protease is derived from a strain of *Thermobifida*, preferably a strain of *Thermobifida cellulosytica*.

127. The process of any one of paragraphs 71-126, wherein the protease is the one shown in SEQ ID NO: 139, or a protease having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 139.

128. The process of any one of paragraphs 71-127, wherein a glucoamylase is present and/or added during saccharification and/or fermentation.

129. The process of paragraphs 71-128, wherein the glucoamylase present and/or added during saccharification and/or fermentation is of fungal origin, preferably from a stain of *Aspergillus*, preferably *A. niger, A. awamori*, or *A. oryzae*; or a strain of *Trichoderma*, preferably *T. reesei*; or a strain of *Talaromyces*, preferably *Talaromyces emersonii*, or a strain of *Trametes*, preferably *Trametes cingulata*, or a strain of *Pycnoporus*, or a strain of *Gloeophyllum*, such as a strain of *Gloeophyllum sepiarum* or *Gloeophyllum trabeum* or a strain of the *Nigrofomes*.

130. The process of any one of paragraphs 71-129, wherein the glucoamylase present and/or added during saccharification and/or fermentation is a blend comprising *Talaromyces emersonii* glucoamylase of SEQ ID NO: 132, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 132, a *Trametes cingulata* glucoamylase of SEQ ID NO: 131, or glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 131, and a *Rhizomucor pusillus* alpha-amylase with an *Aspergillus niger* glucoamylase linker and starch-binding domain (SBD), of SEQ ID NO: 136, and comprising the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

131. The process of any one of paragraphs 71-130, wherein the glucoamylase present and/or added during saccharification and/or fermentation is a blend comprising *Gloeophyllum sepiarium* glucoamylase shown as SEQ ID NO: 134, or a glucoamylase having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 134, and an alpha-amylase from *Rhizomucor pusillus* with an *Aspergillus niger* glucoamylase linker and starch-binding domain (SBD), disclosed SEQ ID NO: 136 with the following substitutions: G128D+D143N, and having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 136.

132. The process of any one of paragraphs 71-131, wherein a trehalase is present and/or added during saccharification and/or fermentation.

133. The process of paragraph 132, wherein the trehalase present and/or added during saccharification and/or fermentation is a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 137 and having trehalase activity.

134. The process of paragraph 133, wherein the trehalase present and/or added during saccharification and/or fermentation is a polypeptide having at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity to the mature polypeptide of SEQ ID NO: 138 and having trehalase activity.

135. The process of any one of paragraphs 71-134, wherein fermentation or simultaneous saccharification and fermentation (SSF) are carried out at a temperature from 25° C. to 40° C., such as from 28° C. to 35° C., such as from 30° C. to 34° C., preferably around about 32° C.

136. The process of any one of paragraphs 71-135, wherein the fermentation product is recovered after fermentation, such as by distillation.

137. The process of any one of paragraphs 71-124, wherein the starch-containing starting material is whole grains.

138. The process of any one of paragraphs 71-137, wherein the starch-containing material is derived from corn, wheat, barley, rye, milo, sago, cassava, manioc, tapioca, sorghum, rice or potatoes.

139. The process of any one of paragraphs 71-138, wherein the cellulosic-containing material is selected from the group consisting of agricultural residue, herbaceous material (including energy crops), municipal solid waste, pulp and paper mill residue, waste paper, and wood (including forestry residue).

140. The process of any one of paragraphs 71-139, wherein the cellulosic-containing material is arundo, bagasse, bamboo, corn cob, corn fiber, corn stover, miscanthus, rice straw, switchgrass, and wheat straw.

141. The process of any one of paragraphs 71-140, wherein the cellulosic-containing material is selected from the group consisting of aspen, eucalyptus, fir, pine, poplar, spruce, or willow.

142. The process of any one of paragraphs 1-141, wherein the cellulosic-containing material is selected from the group consisting of algal cellulose, bacterial cellulose, cotton linter, filter paper, microcrystalline cellulose (e.g., AVICEL®), or phosphoric-acid treated cellulose 143. The process of any one of paragraphs 71-142, wherein the cellulosic-containing material is an aquatic biomass.

144. The process of any one of paragraphs 71-143, wherein the cellulosic-containing material is a whole stillage byproduct of a process for producing a fermentation product from a starch-containing material.

145. The process of any one of paragraphs 71-144, wherein the organism applied in fermentation is a yeast, particularly a *Saccharomyces* spp., more particular *Saccharomyces cerevisiae*.

146. An enzyme blend or enzyme composition comprising at least one polypeptide having beta-1,6-glucanase activity of any one of paragraphs 1-145 and/or at least one polypeptide having endo- and/or exo-beta-1,3-glucanase activity of any one of paragraphs 1-145.

147. The blend or composition of paragraph 147, wherein the at least one polypeptide having beta-1,6-glucanase activity and the at least one polypeptide having beta-1,3-glucanase activity is present in a ratio based on beta-1,6-glucanase to beta-1,3-glucanase of 1:10; 1:5; 1:2.5; 1:2; 1:1.5; 1:1; 1:0.9; 1:0.8; 1:0.7; 1:0.6; 1:0.5; 1:0.4; 1:0.3; 1:0.2.

148. The blend or composition of paragraph 146 or 147, further comprising a carbohydrate-source generating enzyme, particularly a glucoamylase.

149. The blend or composition of any one of paragraphs 146-148, further comprising a cellulase/cellulolytic composition according to any one of paragraphs 84-96.

150. A recombinant host cell comprising at least one heterologous polynucleotide encoding a polypeptide having beta-1,6-glucanase activity, and/or at least one heterologous polynucleotide encoding a polypeptide having endo- and/or exo-beta-1,3-glucanase activity.

151. The recombinant host cell of paragraph 150, wherein the polypeptide having beta-1,6-glucanase activity is a member of a glycoside hydrolase (GH) family selected from the group consisting of families GH30 GH5, and GH131, particularly subfamilies GH30_3 and GH5_15.

152. The recombinant host cell of paragraph 150, wherein the polypeptide having beta-1,3-glucanase activity is a member of a glycoside hydrolase (GH) family selected from the group consisting of families GH16, GH55, GH64 and GH131, particularly subfamily GH55_3.

153. The recombinant host cell of any one of paragraphs 150-152, wherein the host cell comprising at least one heterologous polynucleotide encoding a polypeptide having beta-1,6-glucanase activity and at least one heterologous polynucleotide encoding a polypeptide having endo- and/or exo-beta-1,3-glucanase activity.

154. The recombinant host cell of any one of paragraphs 150-153, wherein heterologous polynucleotide encoding a polypeptide having beta-1,6-glucanase activity, and/or heterologous polynucleotide encoding a polypeptide having endo- and/or exo-beta-1,3-glucanase activity is selected from polynucleotides encoding the following combinations of beta-glucanases:
  i) GH5_15 and GH64;
  ii) GH5_15 and GH30_3 and GH16;
  iii) GH5_15 and GH64 and GH16;
  iv) GH5_15 and GH55_3;
  v) GH55_3 and GH64;
  vi) GH5_15 and GH55_3 and GH64;
  vii) GH5_15 and GH131;
  viii) GH16 and GH64;
  ix) G5_15 and GH30_3;
  x) GH16 and GH55_3; and
  xi) GH131 and GH131.

155. The recombinant host cell of any one of paragraphs 150-154, wherein the polypeptide having beta-1,6-glucanase activity, and/or polypeptide having endo- and/or exo-beta-1,3-glucanase activity is selected from the group consisting of:
  (a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity or 100% sequence identity to SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(b) a polypeptide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, which has beta-1,6-glucanase activity and/or endo- and/or exo-beta-1,3-glucanase activity;

(c) a polypeptide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(d) a polypeptide which is encoded by a polynucleotide that hybridizes under medium stringency conditions, medium-high stringency conditions, high stringency conditions, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof, the polypeptide of which has beta-1,6-glucanase activity and/or endo- and/or exo-beta-1,3-glucanase activity;

(e) a polypeptide which is encoded by a polynucleotide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof, the polypeptide of which has beta-1,6-glucanase activity and/or endo- and/or exo-beta-1,3-glucanase activity;

(f) a fragment of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(g) a fragment of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(h) a fragment of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, which has beta-1,6-glucanase activity and/or endo- and/or exo-beta-1,3-glucanase activity;

(i) a variant of SEQ ID NO: 2, SEQ ID NO: 5, SEQ ID NO: 8, SEQ ID NO: 11, SEQ ID NO: 14, SEQ ID NO:

17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119 comprising a substitution, deletion, and/or insertion at one or more positions, which has beta-1,6-glucanase activity and/or endo- and/or exo-beta-1,3-glucanase activity;

(j) a variant of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119 comprising a substitution, deletion, and/or insertion at one or more positions, which has beta-1,6-glucanase activity and/or endo- and/or exo-beta-1,3-glucanase activity;

(k) a variant of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120 comprising a substitution, deletion, and/or insertion at one or more positions, which has beta-1,6-glucanase activity and/or endo- and/or exo-beta-1,3-glucanase activity (l) a polypeptide comprising, consisting essentially of, or consisting of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119;

(m) a polypeptide comprising, consisting essentially of, or consisting of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120;

(n) a polypeptide comprising, consisting essentially of, or consisting of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119; and (o) a polypeptide comprising SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, and an N-terminal extension and/or C-terminal extension of 1-10 amino acids, e.g., 1, 2, 3, 4, 5, 6, 7, 8, 9, or 10 amino acids.

156. The recombinant host cell of any one of paragraphs 150-155, wherein the at least one heterologous polynucleotide encoding a polypeptide having beta-1,6-glucanase activity encodes at least one, at least two, at least three, at least four, or at least five polypeptides having beta-1,6-glucanase activity.

157. The recombinant host cell of any one of paragraphs 150-156, wherein the at least one heterologous polynucleotide encoding a polypeptide having beta-1,3-glucanase activity encodes at least one, at least two, at least three, at least four, or at least five polypeptides having beta-1,3-glucanase activity.

158. The recombinant host cell of any one of paragraphs 150-157, wherein the at least one heterologous polynucleotide encoding a polypeptide having beta-1,6-glucanase activity, and/or at least one heterologous polynucleotide encoding a polypeptide having endo- and/or exo-beta-1,3-glucanase activity is operably linked to a promoter that is foreign to the polynucleotide.

159. The recombinant host cell of any one of paragraphs 150-158, wherein the cell further comprises a heterologous polynucleotide encoding a glucoamylase.

160. The recombinant host cell of any one of paragraphs 150-159, wherein the heterologous polynucleotide encoding the glucoamylase is operably linked to a promoter that is foreign to the polynucleotide.

161. The recombinant host cell of any one of paragraphs 150-160, wherein the cell further comprises a heterologous polynucleotide encoding an alpha-amylase.

162. The recombinant host cell of any one of paragraphs 150-161, wherein the heterologous polynucleotide encoding the alpha-amylase is operably linked to a promoter that is foreign to the polynucleotide.

163. The recombinant host cell of any one of paragraphs 150-162, wherein the cell further comprises a heterologous polynucleotide encoding a protease.

164. The recombinant host cell of any one of paragraphs 150-163, wherein the heterologous polynucleotide encoding the protease is operably linked to a promoter that is foreign to the polynucleotide.

165. The recombinant host cell of any one of paragraphs 150-164, wherein the cell further comprises a disruption to an endogenous gene encoding a glycerol 3-phosphate dehydrogenase (GPD).

166. The recombinant host cell of any one of paragraphs 150-165, wherein the cell further comprises a disruption to an endogenous gene encoding a glycerol 3-phosphatase (GPP).

167. The recombinant host cell of any one of paragraphs 150-166, wherein the cell is a yeast cell.

168. The recombinant host cell of any one of paragraphs 150-167, wherein the cell is a *Saccharomyces, Rhodotorula, Schizosaccharomyces, Kluyveromyces, Pichia, Hansenula, Rhodosporidium, Candida, Yarrowia, Lipomyces, Cryptococcus,* or *Dekkera* sp. cell.

169. The recombinant host cell of any one of paragraphs 150-168, wherein the cell is a *Saccharomyces cerevisiae* cell.

170. A composition comprising the recombinant host cell of any one of paragraphs 150-169 and one or more naturally occurring and/or non-naturally occurring components, such as components are selected from the group consisting of: surfactants, emulsifiers, gums, swelling agents, and antioxidants.

171. A composition comprising the recombinant host cell of any one of paragraphs 150-169 and at least one additional enzyme selected from the group consisting of an alpha-galactosidase, alpha-glucosidase, aminopeptidase, amylase, beta-galactosidase, beta-glucosidase, beta-xylosidase, carbohydrase, carboxypeptidase, catalase, cellobiohydrolase, cellulase, chitinase, cutinase, cyclodextrin glycosyltransferase, deoxyribonuclease, endoglucanase, esterase, glucoamylase, invertase, laccase, lipase, mannosidase, mutanase, oxidase, pectinolytic enzyme, peroxidase, phytase, polyphenoloxidase, proteolytic enzyme, ribonuclease, transglutaminase, trehalase, and xylanase.

172. Use of a recombinant host cell of any of paragraphs 150-169 in the production of ethanol.

173. A composition comprising:
(i) a recombinant yeast host cell or fermenting organism, wherein the yeast host cell or fermenting organism comprises a heterologous polynucleotide encoding a glucoamylase, an alpha-amylase, protease, and/or cellulase; and
(ii) a polypeptide having beta-1,6-glucanase activity and/or exo- and/or endo-beta-1,3-glucanase activity selected from the group consisting of:
(a) a polypeptide having at least 60%, at least 65%, at least 70% identity, at least 71% identity, at least 72% identity, at least 73% identity, at least 74% identity, at least 75% identity, at least 76% identity, at least 77% identity, at least 78% identity, at least 79% identity, at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity or 100% sequence identity to SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;
(b) a polypeptide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, which has beta-1,6-glucanase activity and/or endo- and/or exo-beta-1,3-glucanase activity;
(c) a polypeptide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(d) a polypeptide which is encoded by a polynucleotide that hybridizes under medium stringency conditions, medium-high stringency conditions, high stringency conditions, or very high stringency conditions with the full-length complement of the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof, the polypeptide of which has beta-1,6-glucanase activity and/or endo- and/or exo-beta-1,3-glucanase activity;

(e) a polypeptide which is encoded by a polynucleotide having at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% sequence identity to the mature polypeptide coding sequence of SEQ ID NO: 1, SEQ ID NO: 4, SEQ ID NO: 7, SEQ ID NO: 10, SEQ ID NO: 13, SEQ ID NO: 16, SEQ ID NO: 19, SEQ ID NO: 22, SEQ ID NO: 25, SEQ ID NO: 28, SEQ ID NO: 31, SEQ ID NO: 34, SEQ ID NO: 37, SEQ ID NO: 40, SEQ ID NO: 43, SEQ ID NO: 46, SEQ ID NO: 49, SEQ ID NO: 52, SEQ ID NO: 55, SEQ ID NO: 58, SEQ ID NO: 61, SEQ ID NO: 64, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, or SEQ ID NO: 118, or the cDNA thereof, the polypeptide of which has beta-1,6-glucanase activity and/or endo- and/or exo-beta-1,3-glucanase activity;

(f) a fragment of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(g) a fragment of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119, which has beta-1,6-glucanase activity and/or endo- and/or exo-beta-1,3-glucanase activity;

(h) a fragment of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, which has beta-1,6-glucanase activity and/or endo- and/or exo-beta-1,3-glucanase activity;

(i) a variant of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119 comprising a substitution, deletion, and/or insertion at one or more positions, which has beta-1,6-glucanase activity and/or endo- and/or exo-beta-1,3-glucanase activity;

(j) a variant of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119 comprising a substitution, deletion, and/or insertion at one or more positions, which has beta-1,6-glucanase activity and/or endo- and/or exo-beta-1,3-glucanase activity;

(k) a variant of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120 comprising a substitution, deletion, and/or insertion at one or more positions, which has beta-1,6-glucanase activity and/or endo- and/or exo-beta-1,3-glucanase activity (l) a polypeptide comprising, consisting essentially of, or consisting of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119;

(m) a polypeptide comprising, consisting essentially of, or consisting of SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120;

(n) a polypeptide comprising, consisting essentially of, or consisting of a mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 20, SEQ ID NO: 23, SEQ ID NO: 26, SEQ ID NO: 29, SEQ ID NO: 32, SEQ ID NO: 35, SEQ ID NO: 38, SEQ ID NO: 41, SEQ ID NO: 44, SEQ ID NO: 47, SEQ ID NO: 50, SEQ ID NO: 53, SEQ ID NO: 56, SEQ ID NO: 59, SEQ ID NO: 62, SEQ ID NO: 65, SEQ ID NO: 68, SEQ ID NO: 71, SEQ ID NO: 74, SEQ ID NO: 77, SEQ ID NO: 80, SEQ ID NO: 83, SEQ ID NO: 86, SEQ ID NO: 89, SEQ ID NO: 92, SEQ ID NO: 95, SEQ ID NO: 98, SEQ ID NO: 101, SEQ ID NO: 104, SEQ ID NO: 107, SEQ ID NO: 110, SEQ ID NO: 113, SEQ ID NO: 116 or SEQ ID NO: 119; and (o) a polypeptide comprising SEQ ID NO: 3, SEQ ID NO: 6, SEQ ID NO: 9, SEQ ID NO: 12, SEQ ID NO: 15, SEQ ID NO: 18, SEQ ID NO: 21, SEQ ID NO: 24, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, or SEQ ID NO: 120, and an N-terminal extension and/or C-terminal extension of 1-10 amino acids, e.g., 1, 2, 3, 4, 5, 6, 7, 8, 9, or 10 amino acids.

174. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,6-glucanase activity from the GH5_15 family and a polypeptide having beta-1,3-glucanase activity from the GH64 family.

175. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,6-glucanase activity from the GH5_15 family and a polypeptide having beta-1,6-glucanase activity and/or beta-1,3-glucanase activity from the GH131 family.

176. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,3-glucanase activity from the GH16 family and a polypeptide having beta-1,3-glucanase activity from the GH55_3 family.

177. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,6-glucanase activity from the GH5_15 family and a polypeptide having beta-1,3-glucanase activity from the GH30_3 family.

178. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,6-glucanase activity from the GH5_15 family, a polypeptide having beta-1,3-glucanase activity from the GH30_3 family, and a polypeptide having beta-1,3-glucanase activity from the GH16 family.

179. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,6-glucanase activity from the GH5_15 family, a polypeptide having beta-1,3-glucanase activity from the GH64 family, and a polypeptide having beta-1,3-glucanase activity from the GH16 family.

180. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,6-glucanase activity from the GH5_15 family and a polypeptide having beta-1,3-glucanase activity from the GH55_3 family.
181. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,3-glucanase activity from the GH55_3 family and a polypeptide having beta-1,3-glucanase activity from the GH64 family.
182. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,6-glucanase activity from the GH5_15 family, a polypeptide having beta-1,3-glucanase activity from the GH55_3 family, and a polypeptide having beta-1,3-glucanase activity from the GH64 family.
183. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,3-glucanase activity from the GH16 family and a polypeptide having beta-1,3-glucanase activity from the GH64 family.
184. A composition comprising:
  (i) a recombinant yeast host cell or fermenting organism, wherein the yeast host cell or fermenting organism comprises a heterologous polynucleotide encoding a glucoamylase, an alpha-amylase, protease, and/or cellulase; and
  (ii) a polypeptide having beta-1,6-glucanase activity from the GH131 family and a polypeptide having beta-1,3-glucanase activity from the GH131 family.
185. The composition of any one of paragraphs 173-184, further comprising a glucoamylase, such as a glucoamylase of any one of paragraphs 129-131.
186. The composition of any one of paragraphs 173-185, further comprising a cellulase/cellulolytic composition, such as a cellulase/cellulolytic composition of any one of paragraphs 84-96.
187. The composition of any one of paragraphs 173-186, further comprising a trehalase of any one of paragraphs 133-134.
188. The composition of any one of paragraphs 173-187, which is a fermented mash or fermenting mash composition.

The present invention is further described by the following examples that should not be construed as limiting the scope of the invention.

Materials & Methods
Enzymes Used in the Examples:

Alpha-Amylase A (AAA): *Bacillus stearothermophilus* alpha-amylase of SEQ ID NO: 126 with the mutations I181*+G182*+N193F and truncated to 491 amino acids.

Alpha-Amylase 1407 (AA1407): *Bacillus stearothermophilus* alpha-amylase of SEQ ID NO: 126 with the mutations I181*+G182*+N193F+V59A+Q89R+E129V+K177L+R179E+H208Y+K220P+N224L+Q254S truncated to 491 amino acids.

Alpha-Amylase 369 (AA369): *Bacillus stearothermophilus* alpha-amylase of SEQ ID NO: 126 with the mutations: I181*+G182*+N193F+V59A+Q89R+E129V+K177L+R179E+Q254S+M284V truncated to 491 amino acids.

Beta-glucosidase (BG): *Aspergillus fumigatus* beta-glucosidase (SEQ ID NO: 2 in WO 2005/047499 SEQ ID NO: 122 herein) variant F100D, S283G, N456E, F512Y).

Trehalase Tf: *Talaromyces funiculosus* trehalase disclosed herein as SEQ ID NO: 137.

Protease 196: Metallo protease derived from *Thermoascus aurantiacus* CGMCC No. 0670 disclosed as amino acids 1-177 in SEQ ID NO: 127 herein and amino acids 1-177 in SEQ ID NO: 2 in WO 2003/048353 with the following mutations: A27K+D79L+Y82F+S87G+D104P+A112P+A126V+D142L.

Protease PfuS: Protease derived from *Pyrococcus furiosus* shown in SEQ ID NO: 128 herein Alpha-amylase blend X: Blend of Amylase AA369 and Protease PfuS.

Glucoamylase BL: Blend comprising *Talaromyces emersonii* glucoamylase disclosed in SEQ ID NO: 132, *Trametes cingulata* glucoamylase disclosed in SEQ ID NO: 131, and *Rhizomucor pusillus* alpha-amylase with *Aspergillus niger* glucoamylase linker and SBD disclosed as SEQ ID NO: 136 with the following substitutions: G128D+D143N (activity ratio AGU:AGU:FAU(F): approx. 30:7:1).

Glucoamylase BL2: Blend comprising *Gloeophyllum sepiarium* glucoamylase disclosed in SEQ ID NO: 134, Trehalase Tf, and *Rhizomucor pusillus* alpha-amylase with *Aspergillus niger* glucoamylase linker and SBD disclosed as SEQ ID NO: 136 with the following substitutions: G128D+D143N (activity ratio AGU:AGU:FAU(F): approx. 30:7:1).

Glucuronoxylanase: GH30_8 glucuronoxylanase derived from *Chryseobacterium*.

Cellulolytic Composition A (CCA): Cellulolytic composition derived from *Trichoderma reesei* comprising GH61A polypeptide having cellulolytic enhancing activity derived from a strain of *Penicillium emesonii* (SEQ ID NO: 2 in WO 2011/041397 or SEQ ID NO: 121 herein), *Aspergillus fumigatus* beta-glucosidase (SEQ ID NO: 2 in WO 2005/047499 SEQ ID NO: 122 herein) variant F100D, S283G, N456E, F512Y) disclosed in WO 2012/044915; *Aspergillus fumigatus* Cel7A CBH1 disclosed as SEQ ID NO: 6 in WO2011/057140 (SEQ ID NO: 123 herein) and *Aspergillus fumigatus* CBH II disclosed as SEQ ID NO: 18 in WO2011/057140 (SEQ ID NO: 124 herein).

Cellulolytic Composition B (CCB): Cellulolytic composition derived from *Trichoderma reesei* comprising *Aspergillus fumigatus* beta-glucosidase (SEQ ID NO: 2 in WO 2005/047499 SEQ ID NO: 122 herein) variant F100D, S283G, N456E, F512Y) disclosed in WO 2012/044915; *Aspergillus fumigatus* Cel7A CBH1 disclosed as SEQ ID NO: 6 in WO2011/057140 (SEQ ID NO: 123 herein) and *Trichoderma reesei* endoglucanase 1 (Tr EG1) disclosed as SEQ ID NO: 125 herein.

Beta-Glucanases Used in the Examples:

| Organism | GH family | Activity | SEQ ID NO |
|---|---|---|---|
| Trichoderma harzianum | GH5_15 | endo-β-1,6-glucanase | SEQ ID NO: 2 |
| Trichoderma harzianum | GH55_3 | exo-β-1,3-glucanase | SEQ ID NO: 5 |
| Trichoderma harzianum | GH64 (A99) | endo-β-1,3-glucanase | SEQ ID NO: 8 |
| Trichoderma harzianum | GH64 (P3471) | endo-β-1,3-glucanase | SEQ ID NO: 11 |
| Lecanicillium primulinum | GH64 | endo-β-1,3-glucanase | SEQ ID NO: 14 |
| Simplicillium lamellicola | GH64 | endo-β-1,3-glucanase | SEQ ID NO: 17 |
| Simplicillium lamellicola | GH16 | endo-β-1,3(4)-glucanase | SEQ ID NO: 20 |
| Trichoderma reesei | GH16 | endo-β-1,3(4)-glucanase | SEQ ID NO: 23 |
| Trichoderma atroviride | GH16 | endo-β-1,3(4)-glucanase | SEQ ID NO: 26 |
| Emericella nidulans | GH16 | endo-β-1,3(4)-glucanase | SEQ ID NO: 29 |
| Trichoderma harzianum | GH30_3 | endo-β-1,6-glucanase | SEQ ID NO: 32 |
| Simplicillium lamellicola | GH5_15 | endo-β-1,6-glucanase | SEQ ID NO: 35 |
| Trichoderma atroviride | GH5_15 | endo-β-1,6-glucanase | SEQ ID NO: 38 |
| Trichoderma atroviride | GH5_15 | endo-β-1,6-glucanase | SEQ ID NO: 41 |
| Coynascus sepedonium | GH131 | broad specificity on beta-1,3, beta-1,3/4, and/or beta-1,4-glucosidic linkages | SEQ ID NO: 44 |
| Aspergillus wentii | GH131 | broad specificity on beta-1,3, beta-1,3/4, and/or beta-1,4-glucosidic linkages | SEQ ID NO: 47 |
| Acrophialophora fusispora | GH131 | broad specificity on beta-1,3, beta-1,3/4, and/or beta-1,4-glucosidic linkages | SEQ ID NO: 50 |
| Acrophialophora fusispora | GH131 | broad specificity on beta-1,3, beta-1,3/4, and/or beta-1,4-glucosidic linkages | SEQ ID NO: 53 |
| Rhinocladiella sp. | GH131 | broad specificity on beta-1,3, beta-1,3/4, and/or beta-1,4-glucosidic linkages | SEQ ID NO: 56 |
| Nemania serpens | GH131 | broad specificity on beta-1,3, beta-1,3/4, and/or beta-1,4-glucosidic linkages | SEQ ID NO: 59 |
| Talaromyces leycettanus | GH131 | broad specificity on beta-1,3, beta-1,3/4, and/or beta-1,4-glucosidic linkages | SEQ ID NO: 62 |
| Collariella virescens | GH131 | broad specificity on beta-1,3, beta-1,3/4, and/or beta-1,4-glucosidic linkages | SEQ ID NO: 65 |
| Rigidoporus sp-74222 | GH131 | broad specificity on beta-1,3, beta-1,3/4, and/or beta-1,4-glucosidic linkages | SEQ ID NO: 68 |
| Loramyces macrosporus | GH131 | broad specificity on beta-1,3, beta-1,3/4, and/or beta-1,4-glucosidic linkages | SEQ ID NO: 71 |
| Corynascus sepedonium | GH131 | broad specificity on beta-1,3, beta-1,3/4, and/or beta-1,4-glucosidic linkages | SEQ ID NO: 74 |
| Fusarium solani | GH5_15 | endo-β-1,6-glucanase | SEQ ID NO: 77 |
| Gilmaniella humicola | GH30_3 | endo-β-1,6-glucanase | SEQ ID NO: 80 |
| Gliomastix murorum | GH65 | endo-β-1,3-glucanase | SEQ ID NO: 83 |
| Albifimbria verrucaria | GH16 | endo-β-1,3-glucanase | SEQ IDNO: 86 |
| Lecanicillium sp. WMM742 | GH16 | endo-β-1,3-glucanase | SEQ ID NO: 89 |
| Rasamsonia byssochlamydoides | GH5_15 | endo-β-1,6-glucanase | SEQ ID NO: 92 |
| Trichoderma longipile | GH5_15 | endo-β-1,6-glucanase | SEQ ID NO: 95 |
| Trichoderma koningiopsis | GH5_15 | endo-β-1,6-glucanase | SEQ ID NO: 98 |
| Trichoderma koningii | GH5_15 | endo-β-1,6-glucanase | SEQ ID NO: 101 |

-continued

| Organism | GH family | Activity | SEQ ID NO |
|---|---|---|---|
| Trichoderma sinuosum | GH5_15 | endo-β-1,6-glucanase | SEQ ID NO: 104 |
| Trichoderma harzianum | GH55_3 | endo-β-1,3-glucanase | SEQ ID NO: 107 |
| Trichoderma atroviride | GH55_3 | endo-β-1,3-glucanase | SEQ ID NO: 110 |
| Simplicillium lamellicola | GH55_3 | endo-β-1,3-glucanase | SEQ ID NO: 113 |
| Trichoderma atroviride | GH55_3 | endo-β-1,3-glucanase | SEQ ID NO: 116 |
| Trichoderma atroviride | GH30_3 | endo-β-1,6-glucanase | SEQ ID NO: 119 |
| Aspergillus nidulans FGSC A4 | GH16 | endo-β-1,3(4)-glucanase | SEQ ID NO: 144 |
| Trichoderma harzianum | GH16 | endo-β-1,3(4)-glucanase | SEQ ID NO: 147 |
| Hamigera inflate | GH55 | exo-β-1,3-glucanase | SEQ ID NO: 150 |
| Acremonium exiguum | GH64 | endo-β-1,3-glucanase | SEQ ID NO: 153 |

Yeast: RED STAR ETHANOL RED™ available from Leaf, France.

Beta-Glucanase Activity Assays

Beta-Glucanase Activity

Beta-glucanase activity is determined by measuring concentration of reducing sugars (RS) released by a beta-glucanase after hydrolysis of appropriate beta-glucan substrate. Activity of GH16 beta-1, 3(4)-glucanases and GH64 beta-1,3-glucanases is determined using CM-Pachyman (beta-1,3-glucan, P-CMPAC, Megazyme). Activity of GH-5_15 beta-1,6-glucanases and GH30_3 beta-1,6-glucanases is determined using Pustulan (beta-1,6-glucan, YP15423, Carbosynth). The RS concentration is measured using p-hydroxybenzoic acid hydrazide (PHBAH) assay adapted to a 96-well microplate format. In the assay, the reaction between reducing ends of C6 and C5 sugars and PHBAH results in a formation of hydrazones, which have intense yellow color and can be detected by absorbance measurement at 410 nm.

Enzymatic Hydrolysis of Beta-Glucan Substrate

Enzymatic hydrolysis is initiated by combining 80 ul of 2.5 g/L beta-glucan substrate, 10 ul of appropriately diluted enzyme sample, and 10 ul of 50 mM Glucono-Delta-Lactone (GDL) in a hard-shell 96-well PCR plate (HSP-9631, Bio-Rad). GDL is added to inhibit beta-glucosidase activity in an expression host background. Each incubation mixture (total volume 100 ul) includes 2 g/L substrate, enzyme, and 5 mM GDL in 50 mM Na-Acetate buffer, pH 5.0. The plate is sealed with an aluminum sealing tape (Costar #6570, Corning Inc.), and incubated in a thermocycler (Mastercycler Pro 5, Eppendorf) at 50° C. for 10 min, followed by cooling down to 10° C.

Each enzyme sample is serially diluted 2-fold eight times in 50 mM sodium acetate buffer, pH 5.0 to generate protein dose profile, and each enzyme dose is typically assayed in triplicate. Each plate includes two sets of glucose standards, 0.0625-1 mM and 0.3125-5 mM. Glucose standards are prepared by diluting 10 mM stock glucose solution in 50 mM sodium acetate buffer, pH 5.0. Each glucose standard (100 ul) is treated similarly to the samples.

PHBAH Assay.

Upon completion of the enzymatic hydrolysis step, 50 ul of freshly prepared PHBAH reagent is added to each well of a microplate, bringing the total volume in each well to 150 ul. The PHBAH reagent is prepared just prior to use by dissolving 1.5% PHBAH in 2% NaOH/50 g/L Na, K Tartrate Tetrahydrate stock solution. The plate is sealed with an aluminum sealing tape (Costar #6570, Corning Inc.), and incubated in a thermocycler (Mastercycler pro S, Eppendorf) at 80° C. for 10 min, followed by cooling down to 4° C.

After the incubation, 100 ul of each well is transferred to a 96-well flat-bottom microplate (Costar #9017, Corning Inc.) using Liquidator 96 pipetting system (Rainin) or appropriate robot protocol. The absorption at 410 nm (A410) is measured using SpectraMax M5 plate reader (Molecular Devices). If any of the A410 values are greater than 2.5, the plate is additionally diluted with DDI water (typically by a factor of 5), and the A410 is read again.

RS concentration in each well (mM) is calculated using a standard glucose curve. Only A410 values that fall within the 0.05-2.5 range are included in the calculations. Specific activity of each beta-glucanase (umol RS/(min*mg protein)) is calculated from the initial slope of each protein dose response curve (mmol RS/mg protein). Only the data within a linear range of each dose response curve are included in the calculations.

Protease Assays

AZCL-Casein Assay

A solution of 0.2% of the blue substrate AZCL-casein is suspended in Borax/$NaH_2PO_4$ buffer pH9 while stirring. The solution is distributed while stirring to microtiter plate (100 microL to each well), 30 microL enzyme sample is added and the plates are incubated in an Eppendorf Thermomixer for 30 minutes at 45° C. and 600 rpm. Denatured enzyme sample (100° C. boiling for 20 min) is used as a blank. After incubation the reaction is stopped by transferring the microtiter plate onto ice and the coloured solution is separated from the solid by centrifugation at 3000 rpm for 5 minutes at 4° C. 60 microL of supernatant is transferred to a microtiter plate and the absorbance at 595 nm is measured using a BioRad Microplate Reader.

DNA-Assay 50 microL protease-containing sample is added to a microtiter plate and the assay is started by adding 100 microL 1 mM pNA substrate (5 mg dissolved in 100 microL DMSO and further diluted to 10 mL with Borax/$NaH_2PO_4$ buffer pH 9.0). The increase in $OD_{405}$ at room temperature is monitored as a measure of the protease activity.

Glucoamylase Activity (AGU)

Glucoamylase activity may be measured in Glucoamylase Units (AGU).

The Novo Glucoamylase Unit (AGU) is defined as the amount of enzyme, which hydrolyzes 1 micromole maltose per minute under the standard conditions 37° C., pH 4.3, substrate: maltose 23.2 mM, buffer acetate 0.1 M, reaction time 5 minutes.

An autoanalyzer system may be used. Mutarotase is added to the glucose dehydrogenase reagent so that any alpha-D-glucose present is turned into beta-D-glucose. Glucose dehydrogenase reacts specifically with beta-D-glucose in the reaction mentioned above, forming NADH which is determined using a photometer at 340 nm as a measure of the original glucose concentration.

| AMG incubation: | |
|---|---|
| Substrate: | maltose 23.2 mM |
| Buffer: | acetate 0.1M |
| pH: | 4.30 ± 0.05 |
| Incubation temperature: | 37° C. ± 1 |
| Reaction time: | 5 minutes |
| Enzyme working range: | 0.5-4.0 AGU/mL |

| Color reaction: | |
|---|---|
| GlucDH: | 430 U/L |
| Mutarotase: | 9 U/L |
| NAD: | 0.21 mM |
| Buffer: | phosphate 0.12M; 0.15M NaCl |
| pH: | 7.60 ± 0.05 |
| Incubation temperature: | 37° C. ± 1 |
| Reaction time: | 5 minutes |
| Wavelength: | 340 nm |

A folder (EB-SM-0131.02/01) describing this analytical method in more detail is available on request from Novozymes A/S, Denmark, which folder is hereby included by reference.

Acid Alpha-Amylase Activity (AFAU)

Acid alpha-amylase activity may be measured in AFAU (Acid Fungal Alpha-amylase Units), which are determined relative to an enzyme standard. 1 AFAU is defined as the amount of enzyme which degrades 5.260 mg starch dry matter per hour under the below mentioned standard conditions.

Acid alpha-amylase, an endo-alpha-amylase (1,4-alpha-D-glucan-glucanohydrolase, E.C. 3.2.1.1) hydrolyzes alpha-1,4-glucosidic bonds in the inner regions of the starch molecule to form dextrins and oligosaccharides with different chain lengths. The intensity of color formed with iodine is directly proportional to the concentration of starch. Amylase activity is determined using reverse colorimetry as a reduction in the concentration of starch under the specified analytical conditions.

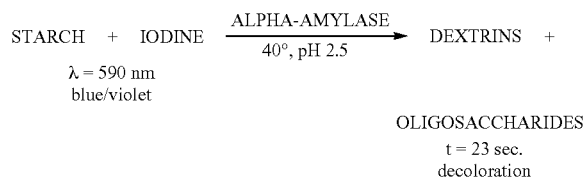

Standard Conditions/Reaction Conditions:
Substrate: Soluble starch, approx. 0.17 g/L
Buffer: Citrate, approx. 0.03 M
Iodine (12): 0.03 g/L
$CaCl_2$: 1.85 mM
pH: 2.50 t 0.05
Incubation temperature: 40° C.
Reaction time: 23 seconds
Wavelength: 590 nm
Enzyme concentration: 0.025 AFAU/mL
Enzyme working range: 0.01-0.04 AFAU/mL A folder EB-SM-0259.02/01 describing this analytical method in more detail is available upon request to Novozymes A/S, Denmark, which folder is hereby included by reference.

Alpha-Amylase Activity (KNU)

The alpha-amylase activity may be determined using potato starch as substrate. This method is based on the break-down of modified potato starch by the enzyme, and the reaction is followed by mixing samples of the starch/enzyme solution with an iodine solution. Initially, a blackish-blue color is formed, but during the break-down of the starch the blue color gets weaker and gradually turns into a reddish-brown, which is compared to a colored glass standard.

One Kilo Novo alpha amylase Unit (KNU) is defined as the amount of enzyme which, under standard conditions (i.e., at 37° C.+/−0.05; 0.0003 M $Ca^{2+}$; and pH 5.6) dextrinizes 5260 mg starch dry substance Merck Amylum solubile.

A folder EB-SM-0009.02/01 describing this analytical method in more detail is available upon request to Novozymes A/S, Denmark, which folder is hereby included by reference.

Determination of FAU(F)

FAU(F) Fungal Alpha-Amylase Units (Fungamyl) is measured relative to an enzyme standard of a declared strength.

| Reaction conditions | |
|---|---|
| Temperature | 37° C. |
| pH | 7.15 |
| Wavelength | 405 nm |
| Reaction time | 5 min |
| Measuring time | 2 min |

A folder (EB-SM-0216.02) describing this standard method in more detail is available on request from Novozymes A/S, Denmark, which folder is hereby included by reference.

Determination of Pullulanase Activity (NPUN)

Endo-pullulanase activity in NPUN is measured relative to a Novozymes pullulanase standard. One pullulanase unit (NPUN) is defined as the amount of enzyme that releases 1 micro mol glucose per minute under the standard conditions (0.7% red pullulan (Megazyme), pH 5, 40° C., 20 minutes). The activity is measured in NPUN/ml using red pullulan.

1 mL diluted sample or standard is incubated at 40° C. for 2 minutes. 0.5 mL 2% red pullulan, 0.5 M KCl, 50 mM citric acid, pH 5 are added and mixed. The tubes are incubated at 40° C. for 20 minutes and stopped by adding 2.5 ml 80% ethanol. The tubes are left standing at room temperature for 10-60 minutes followed by centrifugation 10 minutes at 4000 rpm. OD of the supernatants is then measured at 510 nm and the activity calculated using a standard curve.

The present invention is described in further detail in the following examples which are offered to illustrate the pres-

EXAMPLES

Example 1

Stability of Alpha-Amylase Variants

The stability of a reference alpha-amylase (*Bacillus stearothermophilus* alpha-amylase with the mutations I181*+G182*+N193F truncated to 491 amino acids (using SEQ ID NO: 126 for numbering)) and alpha-amylase variants thereof was determined by incubating the reference alpha-amylase and variants at pH 4.5 and 5.5 and temperatures of 75° C. and 85° C. with 0.12 mM $CaCl_2$ followed by residual activity determination using the EnzChek® substrate (EnzChek® Ultra Amylase assay kit, E33651, Molecular Probes).

Polypeptide enzyme samples were diluted to working concentrations of 0.5 and 1 or 5 and 10 ppm (micrograms/ml) in enzyme dilution buffer (10 mM acetate, 0.01% Triton X100, 0.12 mM $CaCl_2$, pH 5.0). Twenty microliters enzyme sample was transferred to 48-well PCR MTP and 180 microliters stability buffer (150 mM acetate, 150 mM MES, 0.01% Triton X100, 0.12 mM $CaCl_2$, pH 4.5 or 5.5) was added to each well and mixed. The assay was performed using two concentrations of enzyme in duplicates. Before incubation at 75° C. or 85° C., 20 microliters was withdrawn and stored on ice as control samples. Incubation was performed in a PCR machine at 75° C. and 85° C. After incubation samples were diluted to 15 ng/mL in residual activity buffer (100 mM Acetate, 0.01% Triton X100, 0.12 mM $CaCl_2$, pH 5.5) and 25 microliters diluted enzyme was transferred to black 384-MTP. Residual activity was determined using the EnzChek substrate by adding 25 microliters substrate solution (100 micrograms/ml) to each well. Fluorescence was determined every minute for 15 minutes using excitation filter at 485-P nm and emission filter at 555 nm (fluorescence reader is Polarstar, BMG). The residual activity was normalized to control samples for each setup.

Assuming logarithmic decay half life time (T½ (min)) was calculated using the equation: T½ (min)=T(min)*LN (0.5)/LN(% RA/100), where T is assay incubation time in minutes, and % RA is % residual activity determined in assay.

Using this assay setup the half life time was determined for the reference alpha-amylase and variant thereof as shown in Table 1.

TABLE 1

| Mutations | T½ (min) (pH 4.5, 75° C., 0.12 mM $CaCl_2$) | T½ (min) (pH 4.5, 85° C., 0.12 mM $CaCl_2$) | T½ (min) (pH 5.5, 85° C., 0.12 mM $CaCl_2$) |
|---|---|---|---|
| Reference Alpha-Amylase A | 21 | 4 | 111 |
| Reference Alpha-Amylase A with the substitution V59A | 32 | 6 | 301 |
| Reference Alpha-Amylase A with the substitution V59E | 28 | 5 | 230 |
| Reference Alpha-Amylase A with the substitution V59I | 28 | 5 | 210 |
| Reference Alpha-Amylase A with the substitution V59Q | 30 | 6 | 250 |
| Reference Alpha-Amylase A with the substitutions V59A + Q89R + G112D + E129V + K177L + R179E + K220P + N224L + Q254S | 149 | 22 | ND |
| Reference Alpha-Amylase A with thesubstitutions V59A + Q89R + E129V + K177L + R179E + H208Y + K220P + N224L + Q254S | >180 | 28 | ND |
| Reference Alpha-Amylase A with thesubstitutions V59A + Q89R + E129V + K177L + R179E + K220P + N224L + Q254S + D269E + D281N | 112 | 16 | ND |
| Reference Alpha-Amylase A with thesubstitutions V59A + Q89R + E129V + K177L + R179E + K220P + N224L + Q254S + I270L | 168 | 21 | ND |
| Reference Alpha-Amylase A with thesubstitutions V59A + Q89R + E129V + K177L + R179E + K220P + N224L + Q254S + H274K | >180 | 24 | ND |
| Reference Alpha-Amylase A with thesubstitutions V59A + Q89R + E129V + K177L + R179E + K220P + N224L + Q254S + Y276F | 91 | 15 | ND |
| Reference Alpha-Amylase A with the substitutions V59A + E129V + R157Y + K177L + R179E + K220P + N224L + S242Q + Q254S | 141 | 41 | ND |

TABLE 1-continued

| Mutations | T½ (min) (pH 4.5, 75° C., 0.12 mM CaCl$_2$) | T½ (min) (pH 4.5, 85° C., 0.12 mM CaCl$_2$) | T½ (min) (pH 5.5, 85° C., 0.12 mM CaCl$_2$) |
|---|---|---|---|
| Reference Alpha-Amylase A with the substitutions V59A + E129V + K177L + R179E + H208Y + K220P + N224L + S242Q + Q254S | >180 | 62 | ND |
| Reference Alpha-Amylase A with the substitutions V59A + E129V + K177L + R179E + K220P + N224L + S242Q + Q254S | >180 | 49 | >480 |
| Reference Alpha-Amylase A with the substitutions V59A + E129V + K177L + R179E + K220P + N224L + S242Q + Q254S + H274K | >180 | 53 | ND |
| Reference Alpha-Amylase A with the substitutions V59A + E129V + K177L + R179E + K220P + N224L + S242Q + Q254S + Y276F | >180 | 57 | ND |
| Reference Alpha-Amylase A with the substitutions V59A + E129V + K177L + R179E + K220P + N224L + S242Q + Q254S + D281N | >180 | 37 | ND |
| Reference Alpha-Amylase A with the substitutions V59A + E129V + K177L + R179E + K220P + N224L + S242Q + Q254S + M284T | >180 | 51 | ND |
| Reference Alpha-Amylase A with the substitutions V59A + E129V + K177L + R179E + K220P + N224L + S242Q + Q254S + G416V | >180 | 45 | ND |
| Reference Alpha-Amylase A with the substitutions V59A + E129V + K177L + R179E + K220P + N224L + Q254S | 143 | 21 | >480 |
| Reference Alpha-Amylase A with the substitutions V59A + E129V + K177L + R179E + K220P + N224L + Q254S + M284T | >180 | 22 | ND |
| Reference Alpha-Amylase A with thesubstitutions A91L + M96I + E129V + K177L + R179E + K220P + N224L + S242Q + Q254S | >180 | 38 | ND |
| Reference Alpha-Amylase A with the substitutions E129V + K177L + R179E | 57 | 11 | 402 |
| Reference Alpha-Amylase A with the substitutions E129V + K177L + R179E + K220P + N224L + S242Q + Q254S | 174 | 44 | >480 |
| Reference Alpha-Amylase A with the substitutions E129V + K177L + R179E + K220P + N224L + S242Q + Q254S + Y276F + L427M | >180 | 49 | >480 |
| Reference Alpha-Amylase A with the substitutions E129V + K177L + R179E + K220P + N224L + S242Q + Q254S + M284T | >180 | 49 | >480 |
| Reference Alpha-Amylase A with the substitutions E129V + K177L + R179E + K220P + N224L + S242Q + Q254S + N376* + I377* | 177 | 36 | >480 |
| Reference Alpha-Amylase A with the substitutions E129V + K177L + R179E + K220P + N224L + Q254S | 94 | 13 | >480 |
| Reference Alpha-Amylase A with the substitutions E129V + K177L + R179E + K220P + N224L + Q254S + M284T | 129 | 24 | >480 |
| Reference Alpha-Amylase A with the substitutions E129V + K177L + R179E + S242Q | 148 | 30 | >480 |
| Reference Alpha-Amylase A with the substitutions E129V + K177L + R179V | 78 | 9 | >480 |

TABLE 1-continued

| Mutations | T½ (min) (pH 4.5, 75° C., 0.12 mM CaCl$_2$) | T½ (min) (pH 4.5, 85° C., 0.12 mM CaCl$_2$) | T½ (min) (pH 5.5, 85° C., 0.12 mM CaCl$_2$) |
|---|---|---|---|
| Reference Alpha-Amylase A with the substitutions E129V + K177L + R179V + K220P + N224L + S242O + Q254S | 178 | 31 | >480 |
| Reference Alpha-Amylase A with the substitutions K220P + N224L + S242Q + Q254S | 66 | 17 | >480 |
| Reference Alpha-Amylase A with the substitutions K220P + N224L + Q254S | 30 | 6 | 159 |
| Reference Alpha-Amylase A with the substitution M284T | 35 | 7 | 278 |
| Reference Alpha-Amylase A with the substitutions M284V | 59 | 13 | ND |

ND not determined

The results demonstrate that the alpha-amylase variants have a significantly greater half-life and stability than the reference alpha-amylase.

Example 2

Preparation of Protease Variants and Test of Thermostability
Strains and Plasmids E. coli DH12S (available from Gibco BRL) was used for yeast plasmid rescue. pJTP000 is a S. cerevisiae and E. coli shuttle vector under the control of TPI promoter, constructed from pJC039 described in WO 01/92502, in which the Thermoascus aurantiacus M35 protease gene (WO 03048353) has been inserted.

Saccharomyces cerevisiae YNG318 competent cells: MATa Dpep4[cir+] ura3-52, leu2-D2, his 4-539 was used for protease variants expression. It is described in J. Biol. Chem. 272 (15), pp 9720-9727, 1997.

Media and Substrates

10× Basal solution: Yeast nitrogen base w/o amino acids (DIFCO) 66.8 g/l, succinate 100 g/l, NaOH 60 g/l.

SC-glucose: 20% glucose (i.e., a final concentration of 2%=2 g/100 ml)) 100 ml/l, 5% threonine 4 ml/l, 1% tryptophan 10 ml/l, 20% casamino acids 25 m/l, 10× basal solution 100 ml/l. The solution is sterilized using a filter of a pore size of 0.20 micrometer. Agar (2%) and H$_2$O (approx. 761 ml) is autoclaved together, and the separately sterilized SC-glucose solution is added to the agar solution.

YPD; Bacto peptone 20 g/l, yeast extract 10 g/l, 20% glucose 100 ml/l.

YPD+Zn: YPD+0.25 mM ZnSO$_4$.

PEG/LiAc solution: 40% PEG4000 50 ml, 5 M Lithium Acetate 1 ml.

96 well Zein micro titre plate:

Each well contains 200 microL of 0.05-0.1% of zein (Sigma), 0.25 mM ZnSO$_4$ and 1% of agar in 20 mM sodium acetate buffer, pH 4.5.

DNA Manipulations

Unless otherwise stated, DNA manipulations and transformations were performed using standard methods of molecular biology as described in Sambrook et al. (1989) Molecular cloning: A laboratory manual, Cold Spring Harbor lab. Cold Spring Harbor, NY; Ausubel, F. M. et al. (eds.) "Current protocols in Molecular Biology", John Wiley and Sons, 1995; Harwood, C. R. and Cutting, S. M. (Eds.).

Yeast Transformation

Yeast transformation was performed using the lithium acetate method. 0.5 microL of vector (digested by restriction endonucleases) and 1 microL of PCR fragments is mixed. The DNA mixture, 100 microL of YNG318 competent cells, and 10 microL of YEAST MAKER carrier DNA (Clontech) is added to a 12 ml polypropylene tube (Falcon 2059). Add 0.6 ml PEG/LiAc solution and mix gently. Incubate for 30 min at 30° C., and 200 rpm followed by 30 min at 42° C. (heat shock). Transfer to an eppendorf tube and centrifuge for 5 sec. Remove the supernatant and resolve in 3 ml of YPD. Incubate the cell suspension for 45 min at 200 rpm at 30° C. Pour the suspension to SC-glucose plates and incubate 30° C. for 3 days to grow colonies. Yeast total DNA are extracted by Zymoprep Yeast Plasmid Miniprep Kit (ZYMO research).

DNA Sequencing

E. coli transformation for DNA sequencing was carried out by electroporation (BIO-RAD Gene Pulser). DNA Plasmids were prepared by alkaline method (Molecular Cloning, Cold Spring Harbor) or with the Qiagen® Plasmid Kit. DNA fragments were recovered from agarose gel by the Qiagen gel extraction Kit. PCR was performed using a PTC-200 DNA Engine. The ABI PRISM™ 310 Genetic Analyzer was used for determination of all DNA sequences.

Construction of Protease Expression Vector

The Thermoascus M35 protease gene was amplified with the primer pair Prot F and Prot R. The resulting PCR fragments were introduced into S. cerevisiae YNG318 together with the pJC039 vector (described in WO 2001/92502) digested with restriction enzymes to remove the Humicola insolens cutinase gene.

The Plasmid in yeast clones on SC-glucose plates was recovered to confirm the internal sequence and termed as pJTP001.

Construction of Yeast Library and Site-Directed Variants

Library in yeast and site-directed variants were constructed by SOE PCR method (Splicing by Overlap Extension, see "PCR: A practical approach", p. 207-209, Oxford University press, eds. McPherson, Quirke, Taylor), followed by yeast in vivo recombination.

General Primers for Amplification and Sequencing

The primers AM34 and AM35 were used to make DNA fragments containing any mutated fragments by the SOE method together with degenerated primers (AM34+Reverse primer and AM35+forward primer) or just to amplify a whole protease gene (AM34+AM35).

| PCR reaction system: | | Conditions: |
|---|---|---|
| 48.5 microL H₂O | 1 | 94° C. 2 min |
| 2 beads puRe Taq Ready-To-Go PCR (Amersham Biosciences) | 2 | 94° C. 30 sec |
| 0.5 micro L × 2 100 pmole/microL of primers | 3 | 55° C. 30 sec |
| 0.5 microL template DNA | 4 | 72° C. 90 sec |
| | 2-4 | 25 cycles |
| | 5 | 72° C. 10 min |

DNA fragments were recovered from agarose gel by the Qiagen gel extraction Kit. The resulting polypeptide fragments were mixed with the vector digest. The mixed solution was introduced into *Saccharomyces cerevisiae* to construct libraries or site-directed variants by in vivo recombination.

Relative Activity Assay

Yeast clones on SC-glucose were inoculated to a well of a 96-well micro titre plate containing YPD+Zn medium and cultivated at 28° C. for 3 days. The culture supernatants were applied to a 96-well zein micro titer plate and incubated at at least 2 temperatures (ex. 60° C. and 65° C., 70° C. and 75° C., 70° C. and 80° C.) for more than 4 hours or overnight. The turbidity of zein in the plate was measured as A630 and the relative activity (higher/lower temperatures) was determined as an indicator of thermoactivity improvement. The clones with higher relative activity than the parental variant were selected and the sequence was determined.

Remaining Activity Assay

Yeast clones on SC-glucose were inoculated to a well of a 96-well micro titre plate and cultivated at 28° C. for 3 days. Protease activity was measured at 65° C. using azo-casein (Megazyme) after incubating the culture supernatant in 20 mM sodium acetate buffer, pH 4.5, for 10 min at a certain temperature (80° C. or 84° C. with 4° C. as a reference) to determine the remaining activity. The clones with higher remaining activity than the parental variant were selected and the sequence was determined.

Azo-Casein Assay 20 microL of samples were mixed with 150 microL of substrate solution (4 ml of 12.5% azo-casein in ethanol in 96 ml of 20 mM sodium acetate, pH 4.5, containing 0.01% triton-100 and 0.25 mM ZnSO₄) and incubated for 4 hours or longer.

After adding 20 microL/well of 100% trichloroacetic acid (TCA) solution, the plate was centrifuge and 100 microL of supernatants were pipette out to measure A440.

Expression of protease variants in *Aspergillus oryzae*

The constructs comprising the protease variant genes were used to construct expression vectors for *Aspergillus*. The *Aspergillus* expression vectors consist of an expression cassette based on the *Aspergillus niger* neutral amylase II promoter fused to the *Aspergillus nidulans* triose phosphate isomerase non translated leader sequence (Pna2/tpi) and the *Aspergillus niger* amyloglucosidase terminator (Tamg). Also present on the plasmid was the *Aspergillus* selective marker amdS from *Aspergillus nidulans* enabling growth on acetamide as sole nitrogen source. The expression plasmids for protease variants were transformed into *Aspergillus* as described in Lassen et al. (2001), *Appl. Environ. Microbiol.* 67, 4701-4707. For each of the constructs 10-20 strains were isolated, polypeptide and cultivated in shake flasks.

Purification of Expressed Variants

1. Adjust pH of the 0.22 μm filtered fermentation sample to 4.0.
2. Put the sample on an ice bath with magnetic stirring. Add (NH4)2SO4 in small aliquots (corresponding to approx. 2.0-2.2 M (NH4)2SO4 not taking the volume increase into account when adding the compound).
3. After the final addition of (NH4)2SO4, incubate the sample on the ice bath with gentle magnetic stirring for min. 45 min.
4. Centrifugation: Hitachi himac CR20G High-Speed Refrigerated Centrifuge equipped with R20A2 rotor head, 5° C., 20,000 rpm, 30 min.
5. Dissolve the formed precipitate in 200 ml 50 mM Na-acetate pH 4.0.
6. Filter the sample by vacuum suction using a 0.22 μm PES PLUS membrane (IWAKI).
7. Desalt/buffer-exchange the sample to 50 mM Na-acetate pH 4.0 using ultrafiltration (Vivacell 250 from Vivascience equipped with 5 kDa MWCO PES membrane) overnight in a cold room. Dilute the retentate sample to 200 ml using 50 mM Na-acetate pH 4.0. The conductivity of sample is preferably less than 5 mS/cm.
8. Load the sample onto a cation-exchange column equilibrated with 50 mM Na-acetate pH 4.0. Wash unbound sample out of the column using 3 column volumes of binding buffer (50 mM Na-acetate pH 4.0), and elute the sample using a linear gradient, 0-100% elution buffer (50 mM Na-acetate+1 M NaCl pH 4.0) in 10 column volumes.
9. The collected fractions are assayed by an endo-protease assay (cf. below) followed by standard SDS-PAGE (reducing conditions) on selected fractions. Fractions are pooled based on the endo-protease assay and SDS-PAGE.

Endo-Protease Assay

1. Protazyme OL tablet/5 ml 250 mM Na-acetate pH 5.0 is dissolved by magnetic stirring (substrate: endo-protease Protazyme AK tablet from Megazyme—cat. #PRAK 11/08).
2. With stirring, 250 microL of substrate solution is transferred to a 1.5 ml Eppendorf tube.
3. 25 microL of sample is added to each tube (blank is sample buffer).
4. The tubes are incubated on a Thermomixer with shaking (1000 rpm) at 50° C. for 15 minutes.
5. 250 microL of 1 M NaOH is added to each tube, followed by vortexing.
6. Centrifugation for 3 min. at 16,100×G and 25° C.
7. 200 microL of the supernatant is transferred to a MTP, and the absorbance at 590 nm is recorded.

Results

TABLE 2

Relative activity of protease variants. Numbering of substitution(s) starts from N-terminal of the mature peptide in amino acids 1 to 177 of SEQ ID NO: 127.

| Variant | Substitution(s) | Relative activity 65° C./60° C. |
|---|---|---|
| WT | none | 31% |
| JTP004 | S87P | 45% |
| JTP005 | A112P | 43% |
| JTP008 | R2P | 71% |
| JTP009 | D79K | 69% |
| JTP010 | D79L | 75% |
| JTP011 | D79M | 73% |
| JTP012 | D79L/S87P | 86% |
| JTP013 | D79L/S87P/A112P | 90% |
| JTP014 | D79L/S87P/A112P | 88% |

TABLE 2-continued

Relative activity of protease variants. Numbering of substitution(s) starts from N-terminal of the mature peptide in amino acids 1 to 177 of SEQ ID NO: 127.

| Variant | Substitution(s) | Relative activity 65° C./60° C. |
|---|---|---|
| JTP016 | A73C | 52% |
| JTP019 | A126V | 69% |
| JTP021 | M152R | 59% |

TABLE 3

Relative activity of protease variants. Numbering of substitution(s) starts from N-terminal of the mature peptide in amino acids 1 to 177 of SEQ ID NO: 127.

| | | Relative activity | | |
|---|---|---|---|---|
| Variant | Substitution(s) and/or deletion (S) | 70° C./65° C. | 75° C./65° C. | 75° C./70° C. |
| WT | none | 59% | 17% | |
| JTP036 | D79L/S87P/D142L | 73% | 73% | |
| JTP040 | T54R/D79L/S87P | | 71% | |
| JTP042 | Q53K/D79L/S87P/I173V | | 108% | |
| JTP043 | Q53R/D79L/S87P | | 80% | |
| JTP045 | S41R/D79L/S87P | | 82% | |
| JTP046 | D79L/S87P/Q158W | | 96% | |
| JTP047 | D79L/S87P/S157K | | 85% | |
| JTP048 | D79L/S87P/D104R | | 88% | |
| JTP050 | D79L/S87P/A112P/D142L | | 88% | |
| JTP051 | S41R/D79L/S87P/A112P/D142L | | | 102% |
| JTP052 | D79L/S87P/A112P/D142L/S157K | | | 111% |
| JTP053 | S41R/D79L/S87P/A112P/D142L/S157K | | | 113% |
| JTP054 | ΔS5/D79L/S87P | | | 92% |
| JTP055 | ΔG8/D79L/S87P | | | 95% |
| JTP059 | C6R/D79L/S87P | | | 92% |
| JTP061 | T46R/D79L/S87P | | | 111% |
| JTP063 | S49R/D79L/S87P | | | 94% |
| JTP064 | D79L/S87P/N88R | | | 92% |
| JTP068 | D79L/S87P/T114P | | | 99% |
| JTP069 | D79L/S87P/S115R | | | 103% |
| JTP071 | D79L/S87P/T116V | | | 105% |
| JTP072 | N26R/D79L/S87P | | 92% | |
| JTP077 | A27K/D79L/S87P/A112P/D142L | | 106% | |
| JTP078 | A27V/D79L/S87P/A112P/D142L | | 100% | |
| JTP079 | A27G/D79L/S87P/A112P/D142L | | 104% | |

TABLE 4

Relative activity of protease variants. Numbering of substitution(s) starts from N-terminal of the mature peptide in amino acids 1 to 177 of SEQ ID NO: 127.

| | | Relative activity | Remaining activity | |
|---|---|---|---|---|
| Variant | Substitution(s) and/or deletion(s) | 75° C./65° C. | 80° C. | 84° C. |
| JTP082 | ΔS5/D79L/S87P/A112P/D142L | 129% | | 53% |
| JTP083 | T46R/D79L/S87P/A112P/D142L | 126% | | |
| JTP088 | Y43F/D79L/S87P/A112P/D142L | 119% | | |
| JTP090 | D79L/S87P/A112P/T124L/D142L | 141% | | |
| JTP091 | D79L/S87P/A112P/T124V/D142L | 154% | 43% | |
| JTP092 | ΔS5/N26R/D79L/S87P/A112P/D142L | | | 60% |
| JTP095 | N26R/T46R/D79L/S87P/A112P/D142L | | | 62% |
| JTP096 | T46R/D79L/S87P/T116V/D142L | | | 67% |
| JTP099 | D79L/P81R/S87P/A112P/D142L | | | 80% |
| JTP101 | A27K/D79L/S87P/A112P/T124V/D142L | | 81% | |
| JTP116 | D79L/Y82F/S87P/A112P/T124V/D142L | | 59% | |
| JTP117 | D79L/Y82F/S87P/A112P/T124V/D142L | | 94% | |
| JTP127 | D79L/S87P/A112P/T124V/A126V/D142L | | 53% | |

TABLE.5

Relative activity of protease variants. Numbering of substitution(s) starts from N-terminal of the mature peptide in amino acids 1 to 177 of SEQ ID NO: 127.

| Variant | Substitutions | Relative activity 75° C./70° C. | 80° C./70° C. | 85° C./70° C. |
|---|---|---|---|---|
| JTP050 | D79L S87P A112P D142L | 55% | 23% | 9% |
| JTP134 | D79L Y82F S87P A112P D142L | | 40% | |
| JTP135 | S38T D79L S87P A112P A126V D142L | | 62% | |
| JTP136 | D79L Y82F S87P A112P A126V D142L | | 59% | |
| JTP137 | A27K D79L S87P A112P A126V D142L | | 54% | |
| JTP140 | D79L S87P N98C A112P G135C D142L | 81% | | |
| JTP141 | D79L S87P A112P D142L T141C M161C | 68% | | |
| JTP143 | S36P D79L S87P A112P D142L | 69% | | |
| JTP144 | A37P D79L S87P A112P D142L | 57% | | |
| JTP145 | S49P D79L S87P A112P D142L | 82% | 59% | |
| JTP146 | S50P D79L S87P A112P D142L | 83% | 63% | |
| JTP148 | D79L S87P D104P A112P D142L | 76% | 64% | |
| JTP161 | D79L Y82F S87G A112P D142L | | 30% | 12% |
| JTP180 | S70V D79L Y82F S87G Y97W A112P D142L | | 52% | |
| JTP181 | D79L Y82F S87G Y97W D104P A112P D142L | | 45% | |
| JTP187 | S70V D79L Y82F S87G A112P D142L | | 45% | |
| JTP188 | D79L Y82F S87G D104P A112P D142L | | 43% | |
| JTP189 | D79L Y82F S87G A112P A126V D142L | | 46% | |
| JTP193 | Y82F S87G S70V D79L D104P A112P D142L | | | 15% |
| JTP194 | Y82F S87G D79L D104P A112P A126V D142L | | | 22% |
| JTP196 | A27K D79L Y82F S87G D104P A112P A126V D142L | | | 18% |

TABLE 6

Relative activity of protease variants. Numbering of substitution(s) starts from N-terminal of the mature peptide in amino acids 1 to 177 of SEQ ID NO: 127.

| Variant | Substitutions | Relative activity 75° C./70° C. | 80° C./70° C. |
|---|---|---|---|
| JTP196 | A27K D79L Y82F S87G D104P A112P A126V D142L | 102% | |
| JTP210 | A27K Y82F S87G D104P A112P A126V D142L | 107% | 36% |
| JTP211 | A27K D79L Y82F D104P A112P A126V D142L | 94% | 44% |
| JTP213 | A27K Y82F D104P A112P A126V D142L | 103% | 37% |

Example 3

Temperature Profile of Selected Variants Using Polypeptide Enzymes

Selected variants showing good thermo-stability were polypeptide and the polypeptide enzymes were used in a zein-BCA assay as described below. The remaining protease activity was determined at 60° C. after incubation of the enzyme at elevated temperatures as indicated for 60 min.

Zein-BCA Assay:

Zein-BCA assay was performed to detect soluble protein quantification released from zein by variant proteases at various temperatures.

Protocol:

1) Mix 10 ul of 10 ug/ml enzyme solutions and 100 ul of 0.025% zein solution in a micro titer plate (MTP).
2) Incubate at various temperatures for 60 min.
3) Add 10 ul of 100% trichloroacetic acid (TCA) solution.
4) Centrifuge MTP at 3500 rpm for 5 min.
5) Take out 15 ul to a new MTP containing 100 ul of BCA assay solution (Pierce Cat #:23225, BCA Protein Assay Kit).
6) Incubate for 30 min. at 60° C.
7) Measure A562.

The results are shown in Table 7. All of the tested variants showed an improved thermo-stability as compared to the wt protease.

TABLE 7

Zein-BCA assay

| WT/Variant | Sample incubated 60 min at indicated temperatures (° C.) (µg/ml Bovine serum albumin equivalent peptide released) | | | | | | |
|---|---|---|---|---|---|---|---|
| | 60° C. | 70° C. | 75° C. | 80° C. | 85° C. | 90° C. | 95° C. |
| WT | 94 | 103 | 107 | 93 | 58 | 38 | |
| JTP050 | 86 | 101 | 107 | 107 | 104 | 63 | 36 |
| JTP077 | 82 | 94 | 104 | 105 | 99 | 56 | 31 |
| JTP188 | 71 | 83 | 86 | 93 | 100 | 75 | 53 |
| JTP196 | 87 | 99 | 103 | 106 | 117 | 90 | 38 |

Example 4

Thermostability of Protease Pfu.

The thermostability of the *Pyrococcus furiosus* protease (Pfu S) purchased from Takara Bio Inc, (Japan) was tested using the same methods as in Example 2. It was found that the thermostability (Relative Activity) was 110% at (80° C./70° C.) and 103% (90° C./70° C.) at pH 4.5.

Example 5. Beta-Glucanase Activity Assay

Beta-glucanase activity was determined by measuring concentration of reducing sugars (RS) released by a beta-glucanase after hydrolysis of appropriate beta-glucan substrate. Activity of GH16 beta-1,3(4)-glucanases and GH64 beta-1,3-glucanases was determined using CM-Pachyman (beta-1,3-glucan, P-CMPAC, Megazyme). Activity of GH5_15 beta-1,6-glucanases and GH30_3 beta-1,6-glucanases was determined using Pustulan (beta-1,6-glucan, YP15423, Carbosynth). Activity of GH55 beta-1,3-glucanases was determined using Scleroglucan (beta-1,3-glucan with side chains of beta-1,6 glucose every three units, YS09784, Carbosynth). The RS concentration was measured using p-hydroxybenzoic acid hydrazide (PHBAH) assay (Lever, 1972) adapted to a 96-well microplate format. In the assay, the reaction between reducing ends of C6 and C5 sugars and PHBAH results in a formation of hydrazones, which have intense yellow color and can be detected by absorbance measurement at 410 nm.

Enzymatic hydrolysis was initiated by combining 80 ul of 2.5 g/L beta-glucan substrate, 10 ul of appropriately diluted enzyme sample, and 10 ul of 50 mM Glucono-Delta-Lactone (GDL) in a hard-shell 96-well PCR plate (HSP-9631, Bio-Rad). GDL was added to inhibit beta-glucosidase activity in an expression host background. Each incubation mixture (total volume 100 ul) included 2 g/L substrate, enzyme, and 5 mM GDL in 50 mM Na-Acetate buffer, pH 5.0. The plate was sealed with an aluminum sealing tape (Costar #6570, Corning Inc.), and incubated in a thermocycler (Mastercycler Pro S, Eppendorf) at 50° C. for 10 min, followed by cooling down to 10° C.

Each enzyme sample was serially diluted 2-fold eight times in 50 mM sodium acetate buffer, pH 5.0 to generate protein dose response curve, and each enzyme dose (mg protein/L) was typically assayed in triplicate. Each plate included two sets of glucose standards, 0.0625-1 mM and 0.3125-5 mM. Glucose standards were prepared by diluting 10 mM stock glucose solution in 50 mM sodium acetate buffer, pH 5.0. Each glucose standard (100 ul) was treated similarly to the samples.

Upon completion of the enzymatic hydrolysis step, 50 ul of freshly prepared PHBAH reagent was added to each well of a microplate, bringing the total volume in each well to 150 ul. The PHBAH reagent was prepared just prior to use by dissolving 1.5% PHBAH in 2% NaOH/50 g/L Na, K Tartrate Tetrahydrate stock solution. The plate was sealed with an aluminum sealing tape (Costar #6570, Corning Inc.), and incubated in a thermocycler (Mastercycler pro S, Eppendorf) at 80° C. for 10 min, followed by cooling down to 4° C.

After the incubation, 100 ul of each well was transferred to a 96-well flat-bottom microplate (Costar #9017, Corning Inc.) using Liquidator 96 pipetting system (Rainin) or appropriate robot protocol. The absorption at 410 nm (A410) was measured using SpectraMax M5 plate reader (Molecular Devices). If any of the A410 values were greater than 2.5, the plate was additionally diluted with DDI water, typically by a factor of 5, and the A410 was read again.

Concentration of RS (mM) released in each well by enzymatic hydrolysis was calculated using a standard glucose curve. Enzyme dose response curve (mM RS vs mg protein/L) was created for each beta-glucanase, and initial slope was calculated for each curve (mmol RS/mg protein) using data points within linear range of the dose response. Specific activity of each beta-glucanase (umol RS/(min*mg protein)) was calculated based on the initial slope. One unit of beta-glucanase activity (BGU) equals the amount of enzyme (mg protein) capable of releasing 1 micromole of reducing sugars (RS) per minute at pH 5, 50° C.

Example 6: Characterization of the GH5_15 Beta-Glucanase from *Trichoderma harzianum* (SEQ ID NO: 2)

The beta-glucanase assay described in Example 5 was used for obtaining the activity for the GH5_15 beta-glucanase from *Trichoderma harzianum* (SEQ ID NO: 2). The assay was performed using 2 g/L pustulan as a substrate; 10 min, pH 5, 50° C., in 50 mM sodium acetate buffer, 5 mM GDL. The polypeptide of SEQ ID NO: 2 showed enzyme activity as shown in Table 8. Specific activity of the polypeptide of SEQ ID NO: 2 on pustulan was found to be 359.9 BGU/mg protein.

TABLE 8

| Enzyme dose, mg protein/L | Average RS, mM | StDev |
|---|---|---|
| 2.000 | 4.152 | 0.160 |
| 1.000 | 2.724 | 0.153 |
| 0.750 | 2.426 | 0.049 |
| 0.500 | 1.366 | 0.164 |
| 0.250 | 0.353 | 0.062 |
| 0.125 | 0.124 | 0.020 |
| 0.063 | −0.015 | 0.001 |
| 0.031 | −0.104 | 0.004 |

Example 7: Characterization of the GH55_3 Beta-Glucanase from *Trichoderma harzianum* (SEQ ID NO: 5)

The beta-glucanase assay described in Example 5 was used for obtaining the activity for the GH55_3 beta-glucanase from *Trichoderma harzianum* (SEQ ID NO: 5). The assay was performed using 2 g/L scleroglucan as a substrate; 10 min, pH 5, 50° C., in 50 mM sodium acetate buffer, 5 mM GDL. The polypeptide of SEQ ID NO: 5 showed enzyme activity as shown in Table 9. Specific activity of the polypeptide of SEQ ID NO: 5 on scleroglucan was found to be 0.82 BGU/mg protein.

TABLE 9

| Enzyme dose, mg protein/L | Average RS, mM | StDev |
|---|---|---|
| 64.0 | 0.208 | 0.038 |
| 32.0 | 0.124 | 0.040 |
| 16.0 | 0.098 | 0.007 |
| 8.0 | 0.061 | 0.021 |
| 4.0 | 0.030 | 0.015 |
| 2.0 | 0.010 | 0.009 |
| 1.0 | 0.005 | 0.004 |
| 0.5 | −0.010 | 0.004 |

Example 8: Characterization of the GH64 Beta-Glucanase from *Trichoderma harzianum* (SEQ ID NO: 8)

The beta-glucanase assay described in Example 5 was used for obtaining the activity for the GH64 beta-glucanase from *Trichoderma harzianum* (SEQ ID NO: 8). The assay was performed using 2 g/L CM-pachyman as a substrate; 20 min, pH 5, 50° C., in 50 mM sodium acetate buffer, 5 mM GDL. The polypeptide of SEQ ID NO: 8 showed enzyme activity as shown in Table 10. Specific activity of the polypeptide of SEQ ID NO: 8 on CM_pachyman was found to be 14.3 BGU/mg protein.

TABLE 10

| Enzyme dose, mg protein/L | Average RS, mM |
|---|---|
| 16.000 | 2.797 |
| 8.000 | 1.792 |
| 4.000 | 1.142 |
| 2.000 | 0.501 |
| 1.000 | 0.242 |
| 0.500 | 0.087 |
| 0.250 | 0.107 |

Example 9: Characterization of the GH64 Beta-Glucanase from *Trichoderma harzianum* (SEQ ID NO: 11)

The beta-glucanase assay described in Example 5 was used for obtaining the activity for the GH64 beta-glucanase from *Trichoderma harzianum* (SEQ ID NO: 11). The assay was performed using 2 g/L CM-pachyman as a substrate; 10 min, pH 5, 50° C., in 50 mM sodium acetate buffer, 5 mM GDL. The polypeptide of SEQ ID NO: 11 showed enzyme activity as shown in Table 11. Specific activity of the polypeptide of SEQ ID NO: 11 on CM-pachyman was found to be 13.2 BGU/mg protein.

TABLE 11

| Enzyme dose, mg protein/L | Average RS, mM | StDev |
|---|---|---|
| 16.000 | 2.210 | 0.118 |
| 8.000 | 1.209 | 0.194 |
| 6.000 | 1.066 | 0.282 |
| 4.000 | 0.773 | 0.351 |
| 3.000 | 0.600 | 0.249 |
| 2.000 | 0.461 | 0.080 |
| 1.000 | 0.064 | 0.125 |
| 0.500 | −0.078 | 0.002 |

Example 10: Characterization of the GH64 Beta-Glucanase from *Lecanicillium primulinum* (SEQ ID NO: 14)

The beta-glucanase assay described in Example 5 was used for obtaining the activity for the GH64 beta-glucanase from *Lecanicillium primulinum* (SEQ ID NO: 14). The assay was performed using 2 g/L CM-pachyman as a substrate; 10 min, pH 5, 50° C., in 50 mM sodium acetate buffer, 5 mM GDL. The polypeptide of SEQ ID NO: 14 showed enzyme activity as shown in Table 12. Specific activity of the polypeptide of SEQ ID NO: 14 on CM-pachyman was found to be 18.45 BGU/mg protein.

TABLE 12

| Enzyme dose, mg protein/L | Average RS, mM | StDev |
|---|---|---|
| 16.0 | 2.329 | 0.014 |
| 8.0 | 1.440 | 0.036 |
| 4.0 | 0.736 | 0.007 |
| 2.0 | 0.309 | 0.020 |
| 1.0 | 0.136 | 0.003 |
| 0.5 | 0.047 | 0.007 |
| 0.25 | 0.030 | 0.005 |
| 0.125 | 0.013 | 0.006 |

Example 11: Characterization of the GH64 Beta-Glucanase from *Simplicillium lamellicola* (SEQ ID NO: 17)

The beta-glucanase assay described in Example 5 was used for obtaining the activity for the GH64 beta-glucanase from *Simplicillium lamellicola* (SEQ ID NO: 17). The assay was performed using 2 g/L CM-pachyman as a substrate; 20 min, pH 5, 50° C., in 50 mM sodium acetate buffer, 5 mM GDL. The polypeptide of SEQ ID NO: 17 showed enzyme activity as shown in Table 13. Specific activity of the polypeptide of SEQ ID NO: 17 on CM-pachyman was found to be 6.5 BGU/mg protein.

TABLE 13

| Enzyme dose, mg protein/L | Average RS, mM |
|---|---|
| 16.000 | 1.607 |
| 8.000 | 0.994 |
| 4.000 | 0.490 |
| 2.000 | 0.205 |

Example 12: Characterization of the GH16 Beta-Glucanase from *Simplicillium lamellicola* (SEQ ID NO: 20)

The beta-glucanase assay described in Example 5 was used for obtaining the activity for the GH16 beta-glucanase from *Simplicillium lamellicola* (SEQ ID NO: 20). The assay was performed using 2 g/L CM-pachyman as a substrate; 10 min, pH 5, 50° C., in 50 mM sodium acetate buffer, 5 mM GDL. The polypeptide of SEQ ID NO: 20 showed enzyme activity as shown in Table 14. Specific activity of the polypeptide of SEQ ID NO: 20 on CM-pachyman was found to be 115.0 BGU/mg protein.

TABLE 14

| Enzyme dose, mg protein/L | Average RS, mM | StDev |
| --- | --- | --- |
| 2.000 | 1.587 | 0.005 |
| 1.000 | 0.850 | 0.009 |
| 0.500 | 0.620 | 0.091 |
| 0.250 | 0.258 | 0.061 |
| 0.125 | 0.180 | 0.095 |
| 0.063 | 0.116 | 0.123 |

Example 13: Characterization of the GH16 Beta-Glucanase from *Trichoderma reesei* (SEQ ID NO: 23)

The beta-glucanase assay described in Example 5 was used for obtaining the activity for the GH16 beta-glucanase from *Trichoderma reesei* (SEQ ID NO: 26). The assay was performed using 2 g/L CM-pachyman as a substrate; 10 min, pH 5, 50° C., in 50 mM sodium acetate buffer, 5 mM GDL. The polypeptide of SEQ ID NO: 23 showed enzyme activity as shown in Table 15. Specific activity of the polypeptide of SEQ ID NO: 23 on CM-pachyman was found to be 201.7 BGU/mg protein.

TABLE 15

| Enzyme dose, mg protein/L | Average RS, mM | StDev |
| --- | --- | --- |
| 2.000 | 0.984 | 0.011 |
| 1.000 | 0.802 | 0.125 |
| 0.500 | 0.560 | 0.104 |
| 0.250 | 0.449 | 0.111 |
| 0.125 | 0.154 | 0.103 |
| 0.063 | 0.082 | 0.140 |

Example 14: Characterization of the GH16 Beta-Glucanase from *Trichoderma atroviride* (SEQ ID NO: 26)

The beta-glucanase assay described in Example 5 can be used for obtaining the activity for the GH16 beta-glucanase from *Trichoderma atroviride* (SEQ ID NO: 26). The assay can be performed using 2 g/L CM-pachyman as a substrate; 10 min, pH 5, 50° C., in 50 mM sodium acetate buffer, 5 mM GDL. Table 16 can be used to show the enzyme activity for the polypeptide SEQ ID NO: 26. Specific activity of the polypeptide of SEQ ID NO: 26 on CM-pachyman can be reported as BGU/mg protein.

TABLE 16

| Enzyme dose, mg protein/L | Average RS, mM | StDev |
| --- | --- | --- |
| 2.000 | | |
| 1.000 | | |
| 0.500 | | |
| 0.250 | | |
| 0.125 | | |
| 0.063 | | |

Example 15: Characterization of the GH16 Beta-Glucanase from *Aspergillus nidulans* (SEQ ID NO: 29)

The beta-glucanase assay described in Example 5 can be used for obtaining the activity for the GH16 beta-glucanase from *Aspergillus nidulans* (SEQ ID NO: 29). The assay can be performed using 2 g/L CM-pachyman as a substrate; 10 min, pH 5, 50° C., in 50 mM sodium acetate buffer, 5 mM GDL. Table 17 can be used to show the enzyme activity for the polypeptide of SEQ ID NO: 29. Specific activity of the polypeptide of SEQ ID NO: 29 on CM-pachyman can be reported as BGU/mg protein.

TABLE 17

| Enzyme dose, mg protein/L | Average RS, mM | StDev |
| --- | --- | --- |
| 2.000 | | |
| 1.000 | | |
| 0.500 | | |
| 0.250 | | |
| 0.125 | | |
| 0.063 | | |

Example 16: Characterization of the GH30_3 Beta-Glucanase from *Trichoderma harzianum* (SEQ ID NO: 32)

The beta-glucanase assay described in Example 5 was used for obtaining the activity for the GH30_3 beta-glucanase from *Trichoderma harzianum* (SEQ ID NO: 32). The assay was performed using 2 g/L pustulan as a substrate; 20 min, pH 5, 50° C., in 50 mM sodium acetate buffer, 5 mM GDL. The polypeptide of SEQ ID NO: 32 showed enzyme activity as shown in Table 18. Specific activity of the polypeptide of SEQ ID NO: 32 on pustulan was found to be 101.5 BGU/mg protein.

TABLE 18

| Enzyme dose, mg protein/L | Average RS, mM | StDev |
| --- | --- | --- |
| 1.000 | 1.294 | 0.015 |
| 0.500 | 0.990 | 0.035 |
| 0.250 | 0.548 | 0.037 |
| 0.125 | 0.253 | 0.037 |
| 0.063 | 0.118 | 0.023 |
| 0.031 | 0.063 | 0.014 |
| 0.016 | 0.019 | 0.003 |
| 0.008 | 0.000 | 0.008 |

Example 17: Characterization of the GH5_15 Beta-Glucanase from *Simplicillium lamellicola* (SEQ ID NO: 35)

The beta-glucanase assay described in Example 5 was used for obtaining the activity for the GH5_15 beta-glucanase from *Simplicillium lamellicola* (SEQ ID NO: 35). The assay was performed using 2 g/L pustulan as a substrate; 20 min, pH 5, 50° C., in 50 mM sodium acetate buffer, 5 mM GDL. The polypeptide of SEQ ID NO: 35 showed enzyme activity as shown in Table 19. Specific activity of the polypeptide of SEQ ID NO: 35 on pustulan was found to be 165.5 BGU/mg protein.

TABLE 19

| Enzyme dose, mg protein/L | Average RS, mM |
| --- | --- |
| 1.000 | 1.276 |
| 0.500 | 1.158 |

TABLE 19-continued

| Enzyme dose, mg protein/L | Average RS, mM |
|---|---|
| 0.250 | 0.820 |
| 0.125 | 0.475 |
| 0.063 | 0.240 |
| 0.031 | 0.115 |
| 0.016 | 0.058 |
| 0.008 | 0.023 |

Example 18: Characterization of the GH5_15 Beta-Glucanase from *Trichoderma atroviride* (SEQ ID NO: 38)

The beta-glucanase assay described in Example 5 was used for obtaining the activity for the GH5_15 beta-glucanase from *Trichoderma atroviride* (SEQ ID NO: 38). The assay was performed using 2 g/L pustulan as a substrate; 10 min, pH 5, 50° C., in 50 mM sodium acetate buffer, 5 mM GDL. The polypeptide of SEQ ID NO: 38 showed enzyme activity as shown in Table 20. Specific activity of the polypeptide of SEQ ID NO: 38 on pustulan was found to be 256.5 BGU/mg protein.

TABLE 20

| Enzyme dose, mg protein/L | Average RS, mM | StDev |
|---|---|---|
| 2.000 | 3.722 | 0.045 |
| 1.000 | 2.118 | 0.113 |
| 0.750 | 1.722 | 0.014 |
| 0.500 | 0.765 | 0.005 |
| 0.250 | 0.187 | 0.002 |
| 0.125 | 0.021 | 0.012 |

Example 19: Characterization of the GH5_15 Beta-Glucanase from *Trichoderma atroviride* (SEQ ID NO: 41)

The beta-glucanase assay described in Example 5 was used for obtaining the activity for the GH5_15 beta-glucanase from *Trichoderma atroviride* (SEQ ID NO: 41). The assay was performed using 2 g/L pustulan as a substrate; 10 min, pH 5, 50° C., in 50 mM sodium acetate buffer, 5 mM GDL. The polypeptide of SEQ ID NO: 41 showed enzyme activity as shown in Table 21. Specific activity of the polypeptide of SEQ ID NO: 41 on pustulan was found to be 524.6 BGU/mg protein.

TABLE 21

| Enzyme dose, mg protein/L | Average RS, mM | StDev |
|---|---|---|
| 2.000 | 5.003 | 0.080 |
| 1.000 | 4.131 | 0.097 |
| 0.750 | 3.845 | 0.004 |
| 0.500 | 2.685 | 0.125 |
| 0.250 | 1.333 | 0.005 |
| 0.125 | 0.586 | 0.056 |
| 0.063 | 0.313 | 0.010 |
| 0.031 | 0.108 | 0.039 |

Example 20: Characterization of the Broad-Specificity GH131 Beta-Glucanases on Carboxymethyl Cellulose The beta-glucanase assay described in Example 5 was used for obtaining the activity for the GH13 beta-glucanases (SEQ ID NOs: 44, 47, 50, 53, 58, 59, 62, 65, 68, 71 and 74) using Carboxymethyl Cellulose 4M as a substrate (beta-1,4-glucan, P-CMC4M, Megazyme). The assay was performed at pH 5 (50 mM sodium acetate buffer); 5 mM GDL, 10 min, 50° C. The polypeptides of SEQ ID NOs: 44, 47, 50, 53, 56, 59, 62, 65, 68, 71 and 74 showed enzyme activity as shown in Tables 22 and 23.

TABLE 22

| | Reducing sugars, mM | | | | | | | | | | |
|---|---|---|---|---|---|---|---|---|---|---|---|
| Enzyme dose, mg protein/L | SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
| 64.000 | 0.068 | 0.041 | 0.036 | 0.024 | 0.008 | 0.013 | 0.009 | 0.020 | 0.009 | 0.012 | −0.013 |
| 32.000 | 0.024 | 0.011 | 0.009 | 0.019 | −0.005 | −0.002 | −0.005 | 0.002 | −0.004 | −0.002 | −0.015 |
| 16.000 | 0.005 | −0.004 | −0.005 | −0.007 | −0.011 | −0.009 | −0.009 | −0.009 | −0.012 | −0.010 | −0.017 |

TABLE 23

| | Specific activity on carboxymethyl cellulose, BGU/mg protein | | | | | | | | | | |
|---|---|---|---|---|---|---|---|---|---|---|---|
| | SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
| BGU/mg protein | 0.132 | 0.092 | 0.083 | 0.016 | | | | | | | |

Example 21: Characterization of the
Broad-Specificity GH131 Beta-Glucanases on
Beta-Glucan from Barley The beta-glucanase assay described in Example 5 was used for obtaining the activity for the GH131 beta-glucanases (SEQ ID NOs: 44, 47, 50, 53, 56, 59, 62, 65, 68, 71 and 74) using Beta-Glucan from barley as a substrate (mixed linkage beta-1,4(1,3)-glucan, medium viscosity, P-BGBM, Megazyme). The assay was performed at pH 5 (50 mM sodium acetate buffer); 5 mM GDL, 10 min, 50° C. The polypeptides of SEQ ID NOs: 44, 47, 50, 53, 56, 59, 62, 65, 68, 71 and 74 showed enzyme activity as shown in Tables 24 and 25.

TABLE 24

| | Reducing sugars, mM | | | | | | | | | | |
|---|---|---|---|---|---|---|---|---|---|---|---|
| Enzyme dose, mg protein/L | SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
| 64 | 0.399 | 0.101 | 0.315 | 0.075 | 0.034 | 0.140 | 0.086 | 0.050 | 0.057 | 0.047 | 0.002 |
| 32 | 0.229 | 0.041 | 0.165 | 0.028 | 0.010 | 0.078 | 0.049 | 0.022 | 0.029 | 0.019 | −0.007 |
| 16 | 0.118 | 0.015 | 0.075 | 0.003 | −0.005 | 0.031 | 0.017 | 0.002 | 0.005 | 0.003 | −0.012 |
| 8 | 0.042 | −0.006 | 0.026 | −0.013 | −0.016 | 0.007 | 0.000 | −0.009 | −0.009 | −0.010 | −0.017 |

TABLE 25

| | Specific activity on beta-glucan from barley, BGU/mg protein | | | | | | | | | | |
|---|---|---|---|---|---|---|---|---|---|---|---|
| | SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
| BGU/mg protein | 0.623 | 0.180 | 0.511 | 0.148 | 0.075 | 0.236 | 0.152 | 0.099 | 0.107 | 0.090 | |

Example 22: Characterization of the
Broad-Specificity GH131 Beta-Glucanases on
Beta-Glucan from Yeast The beta-glucanase assay described in Example 5 was used for obtaining the activity for the GH131 beta-glucanases (SEQ ID NOs: 44, 47, 50, 53, 56, 59, 62, 65, 68, 71 and 74) using Beta-Glucan from yeast as a substrate (beta-1,3-glucan with beta-1,6 branches, alkali soluble, P-BGYST, Megazyme). The assay was performed at pH 5 (50 mM sodium acetate buffer); 5 mM GDL, 10 min, 50° C. The polypeptides of SEQ ID NOs: 44, 47, 50, 53, 56, 59, 62, 65, 68, 71 and 74 showed enzyme activity as shown in Tables 26 and 27.

TABLE 26

| | Reducing sugars, mM | | | | | | | | | | |
|---|---|---|---|---|---|---|---|---|---|---|---|
| Enzyme dose, mg protein/L | SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
| 64 | 0.574 | 0.163 | 0.370 | 0.128 | 0.089 | 0.107 | 0.081 | 0.063 | 0.070 | 0.025 | 0.027 |
| 32 | 0.285 | 0.112 | 0.251 | 0.035 | 0.047 | 0.095 | 0.049 | 0.027 | 0.057 | 0.032 | −0.004 |
| 16 | 0.216 | 0.084 | 0.159 | 0.068 | 0.025 | 0.095 | 0.069 | −0.056 | 0.004 | 0.069 | 0.021 |
| 8 | 0.117 | 0.040 | 0.095 | 0.019 | 0.022 | 0.082 | 0.072 | 0.035 | 0.051 | 0.058 | 0.036 |
| 4 | 0.048 | −0.017 | 0.024 | 0.003 | 0.005 | 0.013 | −0.021 | −0.009 | −0.018 | −0.014 | −0.019 |
| 2 | −0.073 | −0.023 | 0.001 | −0.027 | −0.031 | 0.010 | −0.004 | 0.001 | −0.020 | −0.005 | 0.007 |

TABLE 27

Specific activity on beta-glucan from yeast, BGU/mg protein

| | SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
|---|---|---|---|---|---|---|---|---|---|---|---|
| BGU/mg protein | 0.788 | 0.201 | 0.476 | 0.167 | 0.125 | 0.038 | 0.018 | 0.121 | 0.072 | | |

Example 23: Characterization of the Broad-Specificity GH131 Beta-Glucanases (SEQ ID NO: 15 to SEQ ID NO: 25) on CM-Pachyman The beta-glucanase assay described in Example 5 was used for obtaining the activity for the GH131 beta-glucanases (SEQ ID NOs: 44, 47, 50, 53, 5, 59, 62, 65, 68, 71 and 74) using CM-Pachyman as a substrate (beta-1,3-glucan, P-CMPAC, Megazyme). The assay was performed at pH 5 (50 mM sodium acetate buffer); 5 mM GDL, 10 min, 50° C. The polypeptides of SEQ ID NOs: 44, 47, 50, 53, 56, 59, 62, 65, 68, 71 and 74 showed enzyme activity as shown in Tables 28 and 29.

TABLE 28

Reducing sugars, mM

| Enzyme dose, mg protein/L | SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
|---|---|---|---|---|---|---|---|---|---|---|---|
| 64 | 0.773 | 0.332 | 0.620 | 0.323 | 0.188 | 0.481 | 0.337 | 0.192 | 0.257 | 0.232 | 0.067 |
| 32 | 0.613 | 0.205 | 0.554 | 0.182 | 0.086 | 0.367 | 0.244 | 0.158 | 0.222 | 0.164 | 0.036 |
| 16 | 0.496 | 0.223 | 0.436 | 0.200 | 0.109 | 0.265 | 0.202 | 0.129 | 0.160 | 0.125 | 0.051 |
| 8 | 0.315 | 0.091 | 0.240 | 0.066 | 0.016 | 0.160 | 0.117 | 0.059 | 0.084 | 0.050 | 0.104 |
| 4 | 0.136 | 0.025 | 0.110 | −0.009 | −0.036 | 0.074 | 0.052 | 0.103 | 0.059 | 0.110 | 0.098 |
| 2 | 0.102 | 0.001 | 0.046 | 0.003 | −0.035 | 0.062 | 0.045 | 0.030 | 0.030 | 0.045 | 0.012 |

TABLE 29

Specific activity on CM-pachyman, BGU/mg protein

| | SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
|---|---|---|---|---|---|---|---|---|---|---|---|
| BGU/mg protein | 2.904 | 0.357 | 1.516 | 0.386 | 0.254 | 0.536 | 0.355 | 0.203 | 0.277 | 0.291 | |

Example 24: Characterization of the Broad-Specificity GH131 Beta-Glucanases on Pustulan The beta-glucanase assay described in Example 5 was used for obtaining the activity for the GH131 beta-glucanases (SEQ ID NOs: 44, 47, 50, 53, 56, 59, 62, 65, 68, 71 and 74) using Pustulan as a substrate (beta-1,6-glucan, YP15423, Carbosynth). The assay was performed at pH 5 (50 mM sodium acetate buffer); 5 mM GDL, 10 min, 50° C. The polypeptides of SEQ ID NOs: 44, 47, 50, 53, 56, 59, 62, 65, 68, 71 and 74 showed enzyme activity as shown in Tables 30 and 31.

TABLE 30

Reducing sugars, mM

| Enzyme dose, mg protein/L | SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
|---|---|---|---|---|---|---|---|---|---|---|---|
| 64 | 0.076 | 0.013 | 0.062 | 0.006 | −0.006 | −0.005 | −0.016 | 0.008 | −0.008 | −0.002 | −0.028 |
| 32 | 0.036 | 0.006 | 0.018 | −0.007 | −0.008 | 0.005 | −0.002 | 0.002 | 0.005 | −0.010 | −0.030 |

TABLE 31

| | Specific activity on pustulan, BGU/mg protein | | | | | | | | | |
|---|---|---|---|---|---|---|---|---|---|---|
| SEQ ID NO: 44 | SEQ ID NO: 47 | SEQ ID NO: 50 | SEQ ID NO: 53 | SEQ ID NO: 56 | SEQ ID NO: 59 | SEQ ID NO: 62 | SEQ ID NO: 65 | SEQ ID NO: 68 | SEQ ID NO: 71 | SEQ ID NO: 74 |
| BGU/mg protein 0.126 | | 0.136 | | | | | | | | |

Example 25: Preparation of the Beta-Glucanases

Media & Strains

All the related media or reagents were sterilized by autoclaving at 121° C. for 20 mins with otherwise specially mentioned.

PDA plates were composed of 39 grams of potato dextrose agar and deionized water to 1 liter.

Horikoshi medium was prepared by adding 10 g glucose, 5 g polypeptone, 5 g yeast extract, 1 g K2HPO4, 0.2 g MgSO4·7H2O, 15 g agar in 900 ml of distilled water, then autoclaving at 121° C. for 20 mins and after autoclaving aseptically adding 100 ml of sterile 10% Na2CO3, finally adjusting to pH 10 with 1 mM NaOH.

YPG medium was composed of 0.4% yeast extract, 0.1% $KH_2PO_4$, 0.05% $MgSO_4$-$7H_2O$, and 1.5% glucose in deionized water.

LB plates were composed of 10 g of Bacto-tryptone, 5 g of yeast extract, 5 g of sodium chloride, 15 g of agar, and deionized water to 1 liter.

LB medium was composed of 10 g of Bacto-tryptone, 5 g of yeast extract, and 5 g of sodium chloride, and deionized water to 1 liter.

LB+Ampicillin medium was prepared by adding 100 mg/ml Ampicillin to LB medium or LB plate at 1:1000.

Selective medium for MT3568 were composed of 342 g of sucrose, 20 g of agar powder, 20 ml of COVE salt solution, and deionized water to 1 liter. The medium was sterilized by autoclaving at 121° C. for 20 minutes. The medium was cooled to 60° C. and 10 ml of 1M acetamide (filter sterilized) was added.

Selective medium for Dau785: simply add 10 ml of 1M NaNO3 instead of acetamide in the above selective medium for MT3568.

TOP agar was composed of 6 g SeaKem GTG agarose, 20 ml of COVE salt solution, 342 g sucrose in a final volume of 1 L with ddH2O. After autoclaving, add 10 ml of 1M NaNO3 for the transformation selection of Dau785 or add 10 ml of 1M Acetamide for the transformation selection of MT3568.

COVE reisolation medium was composed of 30 g of sucrose, 20 ml of COVE salt solution, 20 g of agar, and deionized water up to 1 liter. Autoclave at 121° C. for 20 mins. After cooling to 60 C, the medium was supplemented with 10 ml of Triton X-100, and 10 mM acetamide for MT3568 or 10 mM NaNO3 for Dau785.

COVE slant medium was composed of 30 g of sucrose, 20 ml of COVE salt solution, 20 g of agar, and deionized water up to 1 liter. Autoclave at 121° C. for 20 mins. After cooling to 60 C, the medium was supplemented with 10 mM acetamide for MT3568 or 10 mM NaNO3 for Dau785. COVE salt solution was composed of 26 g of $MgSO_4$·$7H_2O$, 26 g of KCL, 76 g of $KH_2PO_4$, 50 ml of COVE trace metal solution, and deionized water up to 1 liter.

COVE trace metal solution was composed of 0.04 g of $Na_2B_4O_7$·$10H_2O$, 0.4 g of $CuSO_4$·$5H_2O$, 0.8 g of $FeSO_4$·$7H_2O$, 0.8 g of $MnSO_4$·$H_2O$, 0.8 g of $Na_2MoO_4$·$2H_2O$, 8 g of $ZnSO_4$·$7H_2O$, and deionized water up to 1 liter.

DAP4C-1 medium was composed of 0.5 g yeast extract, 10 g maltose, 20 g glucose, 11 g $MgSO_4$·$7H_2O$, 1 g $KH_2PO_4$, 2.2 g Citric acid·$H_2O$, 5.2 g $K_3PO_4$·$H_2O$, supplemented with 0.5 ml of AMG Trace element solution, and deionized water up to 1 liter. Stir to resolve. Aliquot 400 ml to a shake flask of 2 L. Add 1 tablet of 0.5 g calcium carbonate to each flask. After autoclave at 121° C. for 20 mins, 3.3 ml of 20% lactic acid and 9.3 ml of 50% $(NH_4)_2HPO_4$, both sterile, were added to each flask.

AMG Trace element solution was composed of 6.8 g $ZnCl_2$, 2.5 g $CuSO_4$·$5H_2O$, 0.24 g $NiCl_2$·$5H_2O$, 13.9 g $FeS_4$·$7H_2O$, 13.6 g $MnSO_4$·$5H_2O$, 3 g Citric acid·$H_2O$, and deionised water to 1000 ml.

*Escherichia coli* Top-10 competent cells were purchased from TIANGEN (TIANGEN Biotech Co. Ltd., Beijing, China) was used to propagate our expression vector.

*Aspergillus oryzae* strain MT3568 was described WO2014026630A1, example 2, page 29.

*Aspergillus oryzae* strain Dau785 was described in WO2018113745, example 13, page 293.

Cloning, Expression and Purification of Fungal GH131 Broad-Specificity Beta-Glucanases The GH131 broad-specificity beta-glucanases were derived from fungal strains obtained from public strain collections or isolated from environmental sample by standard microbiological isolation techniques. The isolated pure strains were identified, and taxonomy was assigned based on DNA sequencing of the ITS ribosomal genes (Table 32).

TABLE 32

| Strain | Source Country | Mature Polypeptide |
|---|---|---|
| Cornyascus sepedonium UAHM5004 | Australia, 1984 | SEQ ID NO: 45 |
| Aspergillus wentii CBS104.07 | Java, 1896 | SEQ ID NO: 48 |
| Acrophialophora fusispora CBS380.55 | India, 1953 | SEQ ID NO: 51 |
| Acrophialophora fusispora CBS380.55 | India, 1953 | SEQ ID NO: 54 |
| Rhinocladiella sp. | Denmark, 1995 | SEQ ID NO: 57 |
| Nemania serpens HCF00472 | United Kingdom, ? | SEQ ID NO: 60 |
| Talaromyces leycettanus CBS398.68 | United Kingdom, 1968 | SEQ ID NO: 63 |
| Collariella virescens CBS547.75 | India, 1974 | SEQ ID NO: 66 |
| Rigidoporus sp. 74222 | Brazil, 2018 | SEQ ID NO: 69 |
| Loramyces macrosporus CBS235.53 | United Kingdom, 1952 | SEQ ID NO: 72 |
| Cornyascus sepedonium UAHM5004 | Australia, 1984 | SEQ ID NO: 75 |

Chromosomal DNA was isolated from pure cultures and subjected to full genome sequencing using ILLUMINA® technology. Genome sequencing, the subsequent assembly of reads and the gene discovery (i.e. annotation of gene functions) is known to the person skilled in the art and the service can be purchased commercially.

The genome sequences were analyzed for GH131 putative broad-specificity beta-glucanases from the CAZY database GH131 family (Lombard V, Golaconda Ramulu H, Drula E, Coutinho P M, Henrissat B (2014). The Carbohydrate-active enzymes database (CAZy) in 2013. Nucleic Acids Res 42:D490-D495). This analysis identified 11 genes encoding putative GH131 broad-specificity beta-glucanases. The genes encoding the putative GH131 broad-specificity beta-glucanases were cloned by PCR amplification from genomic DNA using gene-specific primers that also append a Kozak translation initiation sequence "TCCACC" immediately 5' of the start codon. The amplified DNA fragments were cloned into cloned into the expression vector pDAu222 as described in WO 2013024021 using BamHI and XhoI restriction sites.

The sequence of the putative GH131 broad-specificity beta-glucanase encoding genes cloned in the expression vector was confirmed and the expression construct was transformed into the *Aspergillus oryzae* strain MT3568 (WO 11/057140) to produce the secreted mature polypeptides with amino acid sequences SEQ ID NO: 45, SEQ ID NO: 48, SEQ ID NO: 51, SEQ ID NO: 54, SEQ ID NO: 57, SEQ ID NO: 60, SEQ ID NO: 63, SEQ ID NO: 66, SEQ ID NO: 69, SEQ ID NO: 72 and SEQ ID NO: 75. Transformants were selected on acetamide during regeneration from protoplasts and subsequently re-isolated under selection (Christensen et al., 1988, *Biotechnology* 6, 1419-1422 and WO 04/032648).

For production of the recombinant GH131 broad-specificity beta-glucanases, a single *Aspergillus* transformant of each construct was cultured in twenty 500 ml baffled flasks each containing 150 ml of DAP-4C-1 medium (WO 12/103350). The cultures were shaken on a rotary table at 150 RPM at 30° C. for 4 days. The culture broth was subsequently separated from cellular material by passage through a 0.22 μm filter.

The recombinant GH131 broad-specificity beta-glucanases were purified according to the following protocol. Filtrated broth was adjusted to pH7.0 and filtrated on 0.22 μm PES filter (Nalge Nunc International, Nalgene labware cat #595-4520). Following, the filtrate was added 1.8M ammonium sulphate. The filtrate was loaded onto a Phenyl Sepharose™ 6 Fast Flow column (high sub) (GE Healthcare, Piscataway, NJ, USA) equilibrated with 1.8M ammonium sulphate, 25 mM HEPES pH7.0. The bound protein was eluted with 1.0M ammonium sulphate, 25 mM HEPES pH 7.0. Fractions were collected and analyzed by SDS-PAGE. The fractions were pooled and applied to a Sephadex™ G-25 (medium) (GE Healthcare, Piscataway, NJ, USA) column equilibrated in 25 mM HEPES pH 7.0. The fractions were applied to a SOURCE™ 15Q (GE Healthcare, Piscataway, NJ, USA) column equilibrated in 25 mM HEPES pH 7.0 and bound proteins were eluted with a linear gradient from 0-1000 mM sodium chloride over 20CV. Fractions were collected and analyzed by SDS-PAGE.

Cloning, Expression, and Purification of Fungal GH55_3 and GH64 Beta-1,3-Glucanases Both of the beta-glucanases of SEQ ID NO: 107 and SEQ ID NO: 12 were derived from the same fungal strain *Trichoderma harzianum* (Table 33).

TABLE 33

| Strain | Source Country | Mature Polypeptide |
|---|---|---|
| *Trichoderma harzianum* CBS223.93 | Switzerland, 1968 | SEQ ID NO: 12 |
| *Trichoderma harzianum* CBS223.93 | Switzerland, 1968 | SEQ ID NO: 107 |

Chromosomal DNA was isolated from pure cultures and subjected to full genome sequencing using ILLUMINA® technology. Genome sequencing, the subsequent assembly of reads and the gene discovery (i.e. annotation of gene functions) is known to the person skilled in the art and the service can be purchased commercially.

The genome sequence was analyzed for GH55 putative beta-1,3-glucanases from the CAZY database GH55 family (Lombard V, Golaconda Ramulu H, Drula E, Coutinho PM, Henrissat B (2014). The Carbohydrate-active enzymes database (CAZy) in 2013. Nucleic Acids Res 42:D490-D495). This analysis identified 12 genes encoding putative GH55 beta-1,3-glucanases. The gene encoding a putative GH55 beta-1,3-glucanase (SEQ ID NO: 107) was cloned by PCR amplification from genomic DNA using gene-specific primers that also append a Kozak translation initiation sequence "TCCACC" immediately 5' of the start codon. The amplified DNA fragments were cloned into cloned into the expression vector pDAu222 as described in WO 2013024021 using BamHI and HindIII restriction sites. Likewise and using the same methodology, the genome sequence was analyzed for putative GH64 beta-1,3-glucanases resulting in the identification of genes encoding enzymes from GH64 (SEQ ID NO: 12). SEQ ID NO: 12 was selected for cloning and expression according to the same methodology as SEQ ID NO: 107.

The sequence of the putative GH55 (SEQ ID NO: 107) and GH64 (SEQ ID NO: 12) beta-glucanase encoding genes cloned in the expression vector was confirmed and the expression constructs was transformed into the *Aspergillus oryzae* strain MT3568 (WO 11/057140) to produce the secreted mature polypeptides with amino acid sequences SEQ ID NO: 12 and SEQ ID NO: 107. Transformants were selected on acetamide during regeneration from protoplasts and subsequently re-isolated under selection (Christensen et al., 1988, *Biotechnology* 6, 1419-1422 and WO 04/032648).

For production of the recombinant GH55 1,3 beta-glucanase, and the GH64 1,3 beta-glucanase, a single *Aspergillus* transformant of each construct was cultured in twenty 500 ml baffled flasks each containing 150 ml of DAP-4C-1 medium (WO 12/103350). The cultures were shaken on a rotary table at 150 RPM at 30° C. for 4 days. The culture broth was subsequently separated from cellular material by passage through a 0.22 μm filter.

Purification of the beta-glucanases of SEQ ID NO: 12 and SEQ ID NO: 107 was performed according to the following protocol. Filtrated broth was adjusted to pH7.0 and filtrated on 0.22 μm PES filter (Nalge Nunc International, Nalgene labware cat #595-4520). Following, the filtrate was added 1.8M ammonium sulphate. The filtrate was loaded onto a Phenyl Sepharose™ 6 Fast Flow column (high sub) (GE Healthcare, Piscataway, NJ, USA) equilibrated with 1.8M ammonium sulphate, 25 mM HEPES pH7.0. The bound protein was eluted with 1.0M ammonium sulphate, 25 mM HEPES pH 7.0. Fractions were collected and analyzed by SDS-PAGE. The fractions were pooled and applied to a Sephadex™ G-25 (medium) (GE Healthcare, Piscataway, NJ, USA) column equilibrated in 25 mM HEPES pH 7.0.

The fractions were applied to a SOURCE™ 15Q (GE Healthcare, Piscataway, NJ, USA) column equilibrated in 25 mM HEPES pH 7.0 and bound proteins were eluted with a linear gradient from 0-1000 mM sodium chloride over 20CV. Fractions were collected and analyzed by SDS-PAGE.

Cloning, Expression, and Purification of Fungal GH64, GH16 and GH5_15 Beta-1,3-Glucanases and Beta-1,6-Glucanases The GH5_15, GH16 and GH64 beta-glucanases were derived from fungal strains obtained from strain collections or isolated from environmental sample by standard microbiological isolation techniques. The isolated pure strains were identified, and taxonomy was assigned based on morphological characteristics and DNA sequencing of the ITS ribosomal genes (Table 34).

TABLE 34

| Strain | Source Country | Mature Polypeptide |
| --- | --- | --- |
| Lecanicillium primulinum NN071582 | China, 2015 | SEQ ID NO: 15 |
| Simplicillium lamellicola NN053792 | China, 2011 | SEQ ID NO: 18 |
|  |  | SEQ ID NO: 21 |
|  |  | SEQ ID NO: 36 |
| Trichoderma atroviride NN053309 | China, 2010 | SEQ ID NO: 27 |
|  |  | SEQ ID NO: 39 |
|  |  | SEQ ID NO: 42 |

Genomic DNA Preparation, Genome Sequencing and Annotation

*Trichoderma atroviride* Strain NN053309

*Trichoderma atroviride* strain NN053309 was inoculated onto a PDA plate and incubated for several days at 25° C. in the darkness. The mycelia were collected by scraping from agar plate with the sterilized scalpel and transferred to Lysing Matrix A tube (MP Biomedicals GmbH, Eschwege, Germany) and frozen under liquid nitrogen. Frozen mycelia were ground by MiniG1600 (SPEX SamplePrep LLC, New Jersey, United States), to a fine powder, and genomic DNA was isolated using DNEASY® Plant Mini Kit (QIAGEN GmbH, Hilden, Germany) following the manufacturer's instruction.

The extracted genomic DNA samples were genome sequenced using an ILLUMINA® MiSeq System (Illumina, Inc., San Diego, CA, USA). The raw reads were assembled using program Spades (Anton Bankevich et al., 2012, *Journal of Computational Biology*, 19(5): 455-477). The assembled sequences were analyzed using standard bioinformatics methods for gene identification and function prediction. GeneMark-ES fungal version (Ter-Hovhannisyan V et al., 2008, *Genome Research* 18(12): 1979-1990) was used for gene prediction. Blastall version 2.2.25 (Altschul et al., 1990, *Journal of Molecular Biology*, 215(3): 403-410) and HMMER version 2.1.1 (National Center for Biotechnology Information (NCBI), Bethesda, MD, USA) were used to predict function based on structural homology. The two GH5 family beta-1,6-glucanases (SEQ ID NO: 39 and SEQ ID NO: 42) and a GH16 family beta-1,3-glucanase (SEQ ID NO: 27) were identified directly by analysis of the Blast results. The Agene program (Munch and Krogh, 2006, *BMC Bioinformatics*, 7:263) and SignalP program (Nielsen et al., 1997, *Protein Engineering*, 10: 1-6) were used to identify start codons. SignalP program was further used to predict signal peptides. Pepstats (Rice et al., 2000, *Trends Genet*, 16(6): 276-277) was used to predict isoelectric points and molecular weights.

*Lecanicillium primulinum* Strain NN071582

*Lecanicillium primulinum* strain NN071582 was inoculated onto a PDA plate and incubated for 7 days at 25° C. in the darkness. Several mycelia-PDA plugs were inoculated into 500 ml shake flasks containing 100 ml of YPG medium. The flasks were incubated for 4 days at 25° C. with shaking at 160 rpm.

The mycelia were collected by filtration through MIRACLOTH® (Calbiochem, La Jolla, CA, USA) and frozen under liquid nitrogen. Frozen mycelia were ground, by a mortar and a pestle, to a fine powder, and genomic DNA was isolated using DNeasy® Plant Maxi Kit (24) (QIAGEN GmbH, Hilden, Germany) following the manufacturer's instruction.

The extracted genomic DNA sample was genome sequenced using an ILLUMINA® MiSeq System. The raw reads were assembled using program Spades (Anton Bankevich et al., 2012, *Journal of Computational Biology*, 19(5): 455-477). The assembled sequences were analyzed using standard bioinformatics methods for gene identification and function prediction. GeneMark-ES fungal version (Ter-Hovhannisyan V et al., 2008, *Genome Research* 18(12): 1979-1990) was used for gene prediction. Blastall version 2.2.25 (Altschul et al., 1990, *Journal of Molecular Biology*, 215(3): 403-410) and HMMER version 2.1.1 (National Center for Biotechnology Information (NCBI), Bethesda, MD, USA) were used to predict function based on structural homology. The GH64 family beta-1,3-glucanase (SEQ ID NO: 15) was identified directly by analysis of the Blast results. The Agene program (Munch and Krogh, 2006, *BMC Bioinformatics*, 7:263) and SignalP program (Nielsen et al., 1997, *Protein Engineering*, 10: 1-6) were used to identify start codons. SignalP program was further used to predict signal peptides. Pepstats (Rice et al., 2000, *Trends Genet*, 16(6): 276-277) was used to predict isoelectric points and molecular weights.

*Simplicillium lamellicola* Strain NN053792

*Simplicillium lamellicola* strain NN053792 was inoculated onto a PDA plate and incubated for 7 days at 25° C. in the darkness. Several mycelia-PDA plugs were inoculated into 500 ml shake flasks containing 100 ml of YPG medium. The flasks were incubated for 4 days at 25° C. with shaking at 160 rpm.

The mycelia were collected by filtration through MIRACLOTH® (Calbiochem, La Jolla, CA, USA) and frozen under liquid nitrogen. Frozen mycelia were ground, by a mortar and a pestle, to a fine powder, and genomic DNA was isolated using DNEASY® Plant Mini Kit following the manufacturer's instruction.

The extracted genomic DNA samples were delivered to Novozymes A/S (Denmark) for genome sequencing using an ILLUMINA® MiSeq System. The raw reads were assembled at Novozymes Denmark using program Spades (Anton Bankevich et al., 2012, *Journal of Computational Biology*, 19(5): 455-477). The assembled sequences were analyzed using standard bioinformatics methods for gene identification and function prediction. GeneMark-ES fungal version (Ter-Hovhannisyan V et al., 2008, *Genome Research* 18(12): 1979-1990) was used for gene prediction. Blastall version 2.2.25 (Altschul et al., 1990, *Journal of Molecular Biology*, 215(3): 403-410) and HMMER version 2.1.1 (National Center for Biotechnology Information (NCBI), Bethesda, MD, USA) were used to predict function based on structural homology. The GH5 family beta-1,6-glucanase (SEQ ID NO: 36), GH16 family beta-1,3-glucanase (SEQ ID NO: 21) and GH64 family beta-1,3-glucanase (SEQ ID NO: 18) were identified directly by analysis of the Blast results. The Agene program (Munch and Krogh, 2006, *BMC Bioinformatics*, 7:263) and SignalP program (Nielsen et al., 1997, *Protein Engineering*, 10: 1-6) were used to identify start codons. SignalP program was further used to predict signal peptides. Pepstats (Rice et al., 2000, *Trends Genet*, 16(6): 276-277) was used to predict isoelectric points and molecular weights.

Cloning, Expression and Cultivation

The expression vectors of pDau724 (described in WO 2016026938A1, page 34, FIG. 7 and SEQ ID NO:30) and pCaHj505 (Described in WO2013/029496) were linearized by BamHI and XhoI and used for gene cloning. The protoplast preparation and plasmid transformation of *Aspergillus oryzae* strains of Dau785 or MT3568 followed the method described in US20140179588A1 Page 21 "Transformation of *Aspergillus* Expression Host" [0271]-[0280]. The 3 genes, tw GH5 family beta-1,6-glucanases (SEQ ID NO: 39 and SEQ ID NO: 42) and a GH16 family beta-1,3-glucanase (SEQ ID NO: 27), were PCR amplified from genomic DNA of *Trichoderma atroviride* strain NN053309 and cloned to pDau724. It resulted in expression constructs of target genes inserted between the NA2/TPi promoter and the terminator of the *A. niger* AMG gene. The plasmids harboring correct expression constructs were then transformed to *Aspergillus oryzae* strain Dau785.

The other 4 genes, the GH64 family beta-1,3-glucanase (SEQ ID NO: 15) was amplified from *Lecanicillium primulinum* strain NN071582, the GH5 family beta-1,6-glucanase (SEQ ID NO: 36), GH16 family beta-1,3-glucanase (SEQ ID NO: 21) and GH64 family beta-1,3-glucanase (SEQ ID NO: 18) were from *Simplicillium lamellicola* strain NN053792, and then cloned to pCaHj505. It resulted in expression constructs of target genes inserted between the TAKA-amylase promoter and the terminator of the *A. niger* AMG gene. The plasmids harboring correct expression constructs were then transformed to *Aspergillus oryzae* strain MT3568.

The expression screening was made by inoculating 1~4 transformants of each gene in Dap4C medium in 24 well plate, shaking at 150 rpm, 30 C, for 3-4 days. The culture broths were then checked by NUPAGE® NOVEX® 4-12% Bis-Tris Gel w/MES (Invitrogen Corporation, Carlsbad, CA, USA) according to the manufacturers instructions with SEEBLUE® Plus2 Pre-stained Protein Standard (Thermo Fisher Scientific, Waltham, MA USA) as the protein marker. The resulting gel was stained with INSTANTBLUE™ (Expedeon Ltd., Babraham Cambridge, UK). All 7 genes showed positive expression with protein bands visualized approximately at 45 kDa for SEQ ID NO: 15; 45 & 50 kDa for SEQ ID NO: 18; 30 kDa for SEQ ID NO: 21; 32 kDa for SEQ ID NO: 27; 45 kDa for SEQ ID NO: 36; 45 kDa for SEQ ID NO: 39 and 45 kDa for SEQ ID NO: 42.

A slant was made for each of the above mentioned expression strains by inoculating the spores of isolated single colonies. The fully sporulated slant was used for inoculation of 4-6 shaking flasks of 2 L containing 400 ml of Dap4C medium each. After 4 days cultivation at 30° C., 80 rpm. The culture broths were harvested by using a 1000 ml Rapid-Flow Bottle Top Filter 0.2 um aPES membrane (ThermoFisher Scientific, Cat #597-4520). The filtered broth samples were purified as described in below.

Purification of Recombinant *Lecanicillium primulinum* GH64 Endo-Beta-1,3-Glucanase from *Aspergillus oryzae* O44YCM 3200 ml supernatant of the recombinant strain O44YCM was precipitated with ammonium sulfate (80% saturation), the protein was re-dissolved in ddH2O, followed by adjusting conductivity to 145 ms/cm with $(NH_4)_2SO_4$, and filtered through a 0.45 μm filter. The final volume was 30 ml. The solution was applied to a 40 ml Phenyl Sepharose High Performance column (GE Healthcare, Buckinghamshire, UK), proteins were washed with a linear 1.8-0.0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 50 kDa were pooled. The pooled solution was dialyzed against 20 mM Tris-HCl, pH 7.5, and applied to a 20 ml MonoQ column equilibrated with 20 mM Tris-HCl, pH 7.5. Proteins were eluted with a linear 0.1-0.25 M NaCl gradient Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 50 kDa were pooled. The pooled solution was adjusted conductivity to 145 ms/cm with (NH4)2SO4 and applied to a 20 ml Phenyl Sepharose High Performance column, proteins were washed with a linear 1.8-0.0 M (NH4)2SO4 gradient. Fractions were analyzed by SDS-PAGE using a NUPAGE® NOVEX®4-12% Bis-Tris Gel with 50 mM MES. The resulting gel was stained with INSTANTBLUE™. Fractions containing a band at approximately 50 kDa were pooled. Then the pooled solution was concentrated by ultrafiltration.

Purification of Recombinant *Simplicillium lamellicola* GH64 Endo-Beta-1,3-Glucanase from *Aspergillus* Oryzae O44S95

800 ml supernatant of the recombinant strain O44S95 was precipitated with ammonium sulfate (80% saturation), the protein was re-dissolved in ddH2O, followed by adjusting conductivity to 145 ms/cm with $(NH_4)_2SO_4$, and filtered through a 0.45 μm filter. The final volume was 30 ml. The solution was applied to a 40 ml Phenyl Sepharose High Performance column (GE Healthcare, Buckinghamshire, UK), proteins were washed with a linear 1.8-0.0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 45 kDa were pooled. The pooled solution was dialyzed against 20 mM NaAc, pH 5.5, and applied to a SP HP 16/10 column equilibrated with 20 mM NaAc, pH 5.5. Proteins were eluted with a linear 0.1-0.25 M NaCl gradient Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 45 kDa were pooled. Then the pooled solution was concentrated by ultrafiltration.

Purification of Recombinant *Simplicillium lamellicola* GH16 from *Aspergillus oryzae* O44S9C 3200 ml supernatant of the recombinant strain O44S9C was precipitated with ammonium sulfate (80% saturation), the protein was re-dissolved in ddH2O, followed by adjusting conductivity to 145 ms/cm with $(NH_4)_2SO_4$, and filtered through a 0.45 μm filter. The final volume was 30 ml. The solution was applied to a 40 ml Phenyl Sepharose High Performance column (GE Healthcare, Buckinghamshire, UK), proteins were washed with a linear 1.8-0.0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 29 kDa were pooled. Then the pooled solution was concentrated by ultrafiltration.

Purification of Recombinant *Trichoderma atroviride* GH16 from *Aspergillus oryzae* O53YUT 1300 ml supernatant of the recombinant strain O53YUT was precipitated with ammonium sulfate (80% saturation), re-dissolved in 20 ml of 20 mM PBS, pH 7.0, dialyzed against the same buffer, and filtered through a 0.45 μm filter. The final volume was 30 ml. The solution was applied to a 40 ml Capto Q column equilibrated with 20 mM PBS, pH 7.0. Proteins were eluted with a linear 0.1-0.25 M NaCl gradient. Unbound proteins were collected and further purified using a 40 ml Phenyl SEPHAROSE® 6 Fast Flow column (GE Healthcare, Buckinghamshire, UK) with a linear 2.0-0 M $(NH_4)_2SO_4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 30 kDa were pooled. Then the pooled solution was concentrated by ultrafiltration.

Purification of Recombinant *Simplicillium lamellicola* GH5 from *Aspergillus oryzae* O44S9D 400 ml supernatant of the recombinant strain O44S9D was precipitated with ammonium sulfate (80% saturation), the protein was re-dissolved in ddH2O, followed by adjusting conductivity to 145 ms/cm with $(NH4)_2SO4$, and filtered through a 0.45 μm filter. The final volume was 30 ml. The solution was applied to a 40 ml Phenyl Sepharose High Performance column (GE Healthcare, Buckinghamshire, UK), proteins were washed with a linear 1.8-0.0 M $(NH4)_2SO4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 47 kDa were pooled. Then the pooled solution was concentrated by ultrafiltration.

Purification of Recombinant *Trichoderma atroviride* GH5 from *Aspergillus oryzae* O53YUN 1200 ml supernatant of the recombinant strain O53YUN was precipitated with ammonium sulfate (80% saturation), the protein was re-dissolved in ddH2O, followed by adjusting conductivity to 145 ms/cm with $(NH4)_2SO4$, and filtered through a 0.45 μm filter. The final volume was 30 ml. The solution was applied to a 40 ml Phenyl Sepharose High Performance column (GE Healthcare, Buckinghamshire, UK), proteins were washed with a linear 1.8-0.0 M $(NH4)_2SO4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 44 kDa were pooled. Then the pooled solution was concentrated by ultrafiltration.

Purification of Recombinant *Trichoderma atroviride* GH5 from *Aspergillus oryzae* O53YUP 1200 ml supernatant of the recombinant strain O53YUP was precipitated with ammonium sulfate (80% saturation), the protein was re-dissolved in ddH2O, followed by adjusting conductivity to 145 ms/cm with $(NH4)_2SO4$, and filtered through a 0.45 μm filter. The final volume was 30 ml. The solution was applied to a 40 ml Phenyl Sepharose High Performance column (GE Healthcare, Buckinghamshire, UK), proteins were washed with a linear 1.8-0.0 M $(NH4)_2SO4$ gradient. Fractions were analyzed by SDS-PAGE using a NUPAGE® NOVEX® 4-12% Bis-Tris Gel with 50 mM MES. The resulting gel was stained with INSTANTBLUE™. Fractions containing a band at approximately 46 kDa were pooled. Then the pooled solution was concentrated by ultrafiltration.

Example 26: Beta-Glucanase Improved Ethanol Yield in Simultaneous Saccharification and Fermentation (SSF) in the Presence of Cellulases This simultaneous saccharification and fermentation (SSF) study was performed with a liquefied corn mash. The corn mash used in this study was made from No. 2 yellow dent corn (midwestern USA) that has been processed sequentially by milling, jet cooking, and liquefying at 85° C. for 2 hours with Alpha-amylase Blend X. The corn mash was prepared in a commercial corn ethanol dry plant. The key enzyme activity in Alpha-amylase Blend X is provided by thermo-stable alpha-amylase and a thermostable protease.

A few polypeptide beta-glucanases belong to family GH5_15, GH55_3, and GH64 were from different organisms shown in Table 25 below. Each beta-glucanase was added on top of a base enzyme mix in this SSF laboratory study. The base enzyme mix consists of Glucoamylase BL, Cellulase CCA, and a Trehalase Tf. The Glucoamylase BL, Cellulase CCA, and the Trehalase Tf were dosed at 0.6 AGU/g DS, 100 ug protein/g DS, and 1 ug protein/g DS, respectively.

In Glucoamylase BL the key enzyme activity is provided by glucoamylase that hydrolyzes (1,4)- and (1,6)-alpha-D-glucosidic linkages at the non-reducing ends of polysaccharides. Cellulase CCA is a cellulase complex comprising of endoglucanases, cellobiohydrolases and beta-glucosidase that hydrolyze cellulose coordinately to glucose. The trehalase hydrolyzes the (1,1)-alpha-D-glucosidic linkage in the disaccharide trehalose.

TABLE 35

| Organism | GH family | Activity | SEQ ID NO |
|---|---|---|---|
| Trichoderma harzianum | GH5_15 | endo-β-1,6-glucanase | 2 |
| Trichoderma harzianum | GH55_3 | exo-β-1,3-glucanase | 5 |
| Trichoderma harzianum | GH64 (A99) | endo-β-1,3-glucanase | 8 |
| Trichoderma harzianum | GH64 (P3471) | endo-β-1,3-glucanase | 11 |
| Lecanicillium primulinum | GH64 | endo-β-1,3-glucanase | 14 |
| Simplicillium lamellicola | GH64 | endo-β-1,3-glucanase | 17 |

In this SSF study, 500 ppm urea and 3 ppm penicillin was added into the corn mash prior to pH adjustment. About 5 gram prepared corn mash was then transferred into 15 ml tubes, and enzymes were pipetted in each tube according to the design of experiment (DOE) in Table 36 below. The SSF was carried out in triplicate of capped tubes in the presence of both enzymes and Ethanol Red yeast (Leaf, France). The Ethanol Red yeast was rehydrated with tap water (1:20 dilution) at 32° C. for 30 minutes prior to adding in SSF slurry at 10 ul/g. The initial SSF conditions were 32% dry solid (DS) and pH5.0. The SSF was performed at 32° C. for 65 hours. Fermentation tubes were vortexed daily.

To stop the fermentation, about 50 ul 40% H2SO4 was added to each tube and vortexed at the end of SSF. After SSF, the fermentation broth was centrifuged at 3500 rpm for 10 minutes, the supernatant was taken and filtered through a 0.2 um Whatman filter. The filtrate was analysed for ethanol and sugar concentrations using Agilent HPLC system equipped with RI detector. The ethanol concentration results are shown in Table 36 below. It is evident that all beta-glucanases improved ethanol yield in SSF in the presence of Cellulase CCA.

TABLE 36

| No | Cellulase CCA ug/g-DS | ThGH5_15 ug/g-DS | ThGH55_3 ug/g-DS | Th GH64 (A99) ug/g-DS | Th GH64 (P3471) ug/g-DS | Lp GH64 ug/g-DS | SI GH64 ug/g-DS | Average Ethanol g/L |
|---|---|---|---|---|---|---|---|---|
| 1 | 100 | | | | | | | 129.00 |
| 2 | 100 | 20 | | | | | | 129.01 |
| 3 | 100 | | 20 | | | | | 129.86 |
| 4 | 100 | | | 20 | | | | 129.94 |
| 5 | 100 | | | | 20 | | | 129.70 |
| 6 | 100 | | | | | 20 | | 129.76 |
| 7 | 100 | | | | | | 20 | 129.47 |

Example 27: Beta-Glucanase Improved Ethanol Yield in Simultaneous Saccharification and Fermentation (SSF) of Corn Mash In this SSF study, the same corn mash was used as in example 26. The SSF was carried out similarly as in example 26 except no cellulase CCA was added in all SSF tubes. Beta-glucanases in Table 37 below were added on top of a base enzyme mix in this SSF laboratory study. The base enzyme mix consists of Glucoamylase BL and a trehalase Tf, dosed at 0.6 AGU/g DS and 1 ug protein/g DS, respectively.

TABLE 37

| Organism | GH family | Activity/SEQ ID NO: |
|---|---|---|
| Trichoderma harzianum | GH5_15 | endo-β-1,6-glucanase/ SEQ ID NO: 2 |
| Trichoderma harzianum | GH55_3 | exo-β-1,3-glucanase/ SEQ ID NO: 5 |
| Trichoderma harzianum | GH64 (A99) | endo-β-1,3-glucanase/ SEQ ID NO: 8 |
| Simplicillium lamellicola | GH64 | endo-β-1,3-glucanase/ SEQ ID NO: 17 |

The fermentation was stopped with acid, samples for HPLC analysis were prepared, and ethanol and sugar concentration were measured the same as in example 26. The average ethanol concentration results are shown in Table 38 below. Compared to no beta-glucanase in No 1, ethanol yield improvement is observed with addition of Th GH5_15, Th GH55_3, or any of GH64 beta-glucanases.

TABLE 38

| No | Th GH5_15 ug/g-DS | Th GH55_3 ug/g-DS | Th GH64 (A99) ug/g-DS | SI GH64 ug/g-DS | Average Ethanol g/l |
|---|---|---|---|---|---|
| 1 | | | | | 128.71 |
| 2 | 20 | | | | 129.82 |
| 3 | | 20 | | | 129.28 |
| 4 | | | 20 | | 129.84 |
| 5 | | | | 20 | 129.45 |

Example 28: Beta-Glucanase Blends Improved Ethanol Yield in SSF in the Presence of Cellulases In this SSF study, the same liquefied corn mash was used as in example 26. The beta-glucanases used are the same as in example 26 and are shown in table 39 below.

TABLE 39

| Organism | GH family | Activity/SEQ ID NO |
|---|---|---|
| Trichoderma harzianum | GH5_15 | endo-β-1,6-glucanase/ SEQ ID NO: 2 |
| Trichoderma harzianum | GH55_3 | exo-β-1,3-glucanase/ SEQ ID NO: 5 |
| Trichoderma harzianum | GH64 (A99) | endo-β-1,3-glucanase/ SEQ ID NO: 8 |
| Trichoderma harzianum | GH64 (P3471) | endo-β-1,3-glucanase/ SEQ ID NO: 11 |
| Lecanicillium primulinum | GH64 | endo-β-1,3-glucanase/ SEQ ID NO: 14 |
| Simplicillium lamellicola | GH64 | endo-β-1,3-glucanase/ SEQ ID NO: 17 |

The SSF was carried out similarly as in example 26 except two or more beta-glucanases were added in the same SSF tube as shown in Table 40 below. Beta-glucanase blends (each at 20 ug/g DS) were added on top of a base enzyme mix in this SSF laboratory study. The base enzyme mix consists of Glucoamylase BL, Cellulase CCA, and a trehalase Tf, dosed at 0.6 AGU/g DS, 100 ug protein/g DS, and 1 ug protein/g DS, respectively.

The fermentation was stopped with acid, samples for HPLC analysis were prepared, and ethanol and sugar concentration were measured the same as in example 26. The average ethanol concentration results are also shown in Table 40 below. Compared to no beta-glucanase in No 1, blends of beta-1,6 glucanase (GH5_15) and any of the beta-1,3-glucanases (GH55_3, or GH 64s) have boosted ethanol yield in SSF. Furthermore, the blend of endo-ß-1, 3-glucanase Th GH64 and exo-ß-1,3-glucanase GH55_3 has improved ethanol yield.

TABLE 40

| No | Cellulase CCA ug/g-DS | ThGH5_15 ug/g-DS | ThGH55_3 ug/g-DS | ThGH64 (A99) ug/g-DS | ThGH64 (P3471) ug/g-DS | LpGH64 ug/g-DS | SIGH64 ug/g-DS | Average Ethanol g/l |
|---|---|---|---|---|---|---|---|---|
| 1 | 100 | | | | | | | 129.00 |
| 2 | 100 | 20 | 20 | | | | | 129.72 |
| 3 | 100 | 20 | | 20 | | | | 130.32 |
| 4 | 100 | 20 | | | | 20 | | 130.99 |

TABLE 40-continued

| No | Cellulase CCA ug/g-DS | ThGH5_15 ug/g-DS | ThGH55_3 ug/g-DS | ThGH64 (A99) ug/g-DS | ThGH64 (P3471) ug/g-DS | LpGH64 ug/g-DS | SlGH64 ug/g-DS | Average Ethanol g/l |
|---|---|---|---|---|---|---|---|---|
| 5 | 100 | 20 | | | | 20 | | 130.00 |
| 6 | 100 | 20 | | | | | 20 | 129.39 |
| 7 | 100 | | 20 | | 20 | | | 130.36 |

Example 29: Beta-Glucanase Blends Improved Ethanol Yield in SSF of Corn Mash In this SSF study, the same corn mash was used as in example 26. The beta-glucanases used are the same as in example 26.

The SSF was carried out similarly as in example 26 except a) two or more beta-glucanases were added in SSF tubes as shown in Table 41 below; and b) enzyme base mix has no cellulase CCA. The base enzyme mix consists of Glucoamylase BL and the trehalase Tf, that were dosed at 0.6 AGU/g DS and 1 ug protein/g DS, respectively.

All HPLC sample preparation and ethanol measurement were the same as in example 21.

TABLE 41

| No | ThGH5_15 ug/g-DS | ThGH55_3 ug/g-DS | ThGH64 (A99) ug/g-DS | ThGH64 (P3471) ug/g-DS | LpGH64 ug/g-DS | SlGH64 ug/g-DS | Average Ethanol g/l |
|---|---|---|---|---|---|---|---|
| 1 | | | | | | | 128.71 |
| 2 | 20 | 20 | | | | | 129.29 |
| 3 | 20 | | 20 | | | | 129.51 |
| 4 | 20 | | | 20 | | | 129.56 |
| 5 | 20 | | | | 20 | | 129.14 |
| 6 | 20 | | | | | 20 | 128.93 |
| 7 | | 20 | | 20 | | | 129.00 |

As shown in Table 41 above, in the absence of cellulases it is still evident that blends of beta-1,6 glucanase (GH5_15) and any of the beta-1,3-glucanases (GH55_3, GH 64s) have boosted ethanol yield in SSF. In addition, the blend of endo-1,3-beta-glucanase Th GH64 and exo-1,3 beta-glucanase GH55_3 has improved ethanol yield.

Furthermore, by comparing ethanol yield of the same beta-glucanase blend in the presence of cellulase CCA (in example 23) to ethanol yield in the absence of cellulase CCA, it is evident that cellulase CCA has boosting effect on ethanol yield in SSF of corn mash.

Example 30: Improved Ethanol Yield with Beta-Glucanase(s) in SSF of Corn Mash In this simultaneous saccharification and fermentation (SSF) study several polypeptide beta-glucanases on top of base enzyme mix were evaluated with a liquefact (i.e. corn mash). This corn mash was from sequential jet cooking and liquefaction with a thermostable alpha-amylase only (i.e. Amylase AA369).

In this SSF study, the base enzyme mix contains 0.6 AGU/gDS of Glucoamylase BL and 100 ug/gDS of cellulase CCA. In addition, 0.6 AGU/gDS of Glucoamylase BL only (no cellulase CCA) was also included as controls of corn mash SSF.

TABLE 42

| Organism | GH family | Activity/SEQ ID NO |
|---|---|---|
| Trichoderma harzianum | Th GH5_15 | endo-β-1,6-glucanase/ SEQ ID NO: 2 |
| Trichoderma harzianum | Th GH30_3 | endo-β-1,6-glucanase/ SEQ ID NO: 32 |
| Trichoderma harzianum | Th GH55_3 | exo-β-1,3-glucanase/ SEQ ID NO: 5 |
| Trichoderma reesei | Tr GH16 | endo-β-1,3(4)-glucanase/ SEQ ID NO: 23 |
| Trichoderma atroviride | Ta GH16 | endo-β-1,3(4)-glucanase/ SEQ ID NO: 26 |
| Simplicillium lamellicola | Sl GH16 | endo-β-1,3(4)-glucanase/ SEQ ID NO: 20 |

In this SSF study, 500 ppm urea and 3 ppm penicillin was added into corn mash, and the slurry was adjusted to pH5.0 and then about 5 gram slurry was transferred into 15 ml tubes, and enzymes were pipetted in each tube according to the design of experiment (DOE) in Table 43 below. The SSF are performed using enzyme(s) and ethanol Red yeast (Leaf, France). The Ethanol Red yeast was diluted with tap water (1:20 dilution) and rehydrated at 32 C for 30 minutes prior to adding in SSF slurry at 10 ul/g. The SSF conditions are: 35% dry solid (DS), initial pH5.0, 32° C. for 60 hours. About 50 ul 40% H2SO4 was added at the end of SSF to stop fermentation. After SSF, the fermentation broth was centrifuged at 3500 rpm for 10 minutes, 150 ul of fermentation supernatant was taken and filtered through a 0.2 um 96 well filter plate. The filtrate was analyzed for ethanol and sugar concentrations using Agilent HPLC system equipped with RI detector.

TABLE 43

| No | CCA ug/gDS | Th GH5_15 ug/gDS | Th GH30_3 ug/gDS | Th GH55_3 ug/gDS | Tr GH16 ug/gDS | Sl GH16 ug/gDS | Ta GH16 ug/gDS | Average Ethanol g/l | ethanol Increase |
|---|---|---|---|---|---|---|---|---|---|
| 1 | | | | | | | | 126.163 | -1.21% |
| 2 | 100 | | | | | | | 127.705 | 0.00% |
| 3 | 100 | 20 | | 20 | | | | 130.330 | 2.06% |
| 4 | 100 | | 20 | 20 | | | | 127.847 | 0.11% |
| 5 | 100 | 20 | | | 20 | | | 128.106 | 0.31% |
| 6 | 100 | | 20 | | 20 | | | 127.961 | 0.20% |
| 7 | 100 | 20 | 20 | | | 20 | | 128.625 | 0.72% |
| 8 | 100 | 20 | 20 | | | | 20 | 128.195 | 0.38% |

From Table 43 above, we observed that 100 ug/gDS of CCA resulted in ethanol increase compared to no CCA addition in SSF. It is also evident that ethanol yield was improved with the addition of enzyme blends of ß-1,6-glucanases (GH5_15 or GH3_3) and either ß-1,3-glucanase (GH55_3) or ß-1,3(4)-glucanase (GH6s).

Example 31: Improved Ethanol Yield with Beta-Glucanase(s) in SSF of Corn Mash

In this simultaneous saccharification and fermentation (SSF) study several polypeptide beta-glucanases and their blends on top of base enzyme were evaluated with a liquefact (i.e. corn mash) which was from sequential jet cooking and liquefaction with Alpha-amylase blend X. The base enzyme contains 0.6 AGU/gDS of Glucoamylase BL and 100 ug/gDS of cellulase CCA. In addition, cellulase CCA doses of 0 and 200 ug/gDS on top of 0.6 AGU/gDS of Glucoamylase BL were also included as negative and positive controls of corn mash SSF.

TABLE 44

| Organism | GH family | Activity/SEQ ID NO |
|---|---|---|
| Trichoderma harzianum | Th GH5_15 | endo-β-1,6-glucanase/ SEQ ID NO: 2 |
| Trichoderma harzianum | Th GH30_3 | endo-β-1,6-glucanase/ SEQ ID NO: 32 |
| Trichoderma harzianum | Th GH55_3 | exo-β-1,3-glucanase/ SEQ ID NO: 5 |
| Trichoderma reesei | TrGH16 | endo-β-1,3(4)-glucanase/ SEQ ID NO: 23 |
| Trichoderma atroviride | TaGH16 | endo-β-1,3(4)-glucanase/ SEQ ID NO: 26 |
| Simplicillium lamellicola | Sl GH16 | endo-β-1,3(4)-glucanase/ SEQ ID NO: 20 |
| Emericella nidulans | En GH16 | endo-β-1,3(4)-glucanase/ SEQ ID NO: 29 |

In this study, 500 ppm urea and 3 ppm penicillin was added into corn mash, and the slurry was adjusted to pH5.0 and then transferred into 15 ml tubes, and enzymes were pipetted in each tube according to the design of experiment (DOE) in Table below 45. The SSF are performed using enzyme(s) and ethanol Red yeast (Leaf, France). The Ethanol Red yeast was diluted with tap water (1:20 dilution) and rehydrated at 32° C. for 30 minutes prior to adding in SSF slurry at 10 ul/g. The SSF conditions are: 35% dry solid (DS), initial pH5.0, 32 C for 48 hours. About 50 ul 40% H2SO4 was added at the end of SSF to stop fermentation.

TABLE 45

| CCA ug/gDS | Th GH55_3 ug/gDS | Th GH5_15 ug/gDS | Th GH30_3 ug/gDS | Tr GH16 ug/gDS | En GH16 ug/gDS | Sl GH16 ug/gDS | Ta GH16 ug/gDS | Ethanol Average g/l | Ethanol increase % |
|---|---|---|---|---|---|---|---|---|---|
| | | | | | | | | 130.663 | -1.96% |
| 100 | | | | | | | | 133.281 | 0.00% |
| 200 | | | | | | | | 133.650 | 0.28% |
| 100 | 20 | | | | | | | 134.678 | 1.05% |
| 100 | | 20 | | | | | | 134.231 | 0.71% |
| 100 | | | 20 | | | | | 135.027 | 1.31% |
| 100 | | | | 20 | | | | 135.153 | 1.41% |
| 100 | | | | | 20 | | | 134.550 | 0.95% |
| 100 | | | | | | 20 | | 135.496 | 1.66% |
| 100 | | | | | | | 20 | 135.836 | 1.92% |
| 100 | 20 | | | 20 | | | | 134.751 | 1.10% |
| 100 | | 20 | | 20 | | | | 135.819 | 1.90% |
| 100 | | 20 | | | | 20 | | 135.940 | 2.00% |
| 100 | | 20 | | | | | 20 | 136.185 | 2.18% |
| 100 | | | 20 | 20 | | | | 136.038 | 2.07% |
| 100 | | 20 | 20 | 20 | | | | 136.543 | 2.45% |
| 100 | 20 | 20 | 20 | | | 20 | | 135.912 | 1.97% |

After SSF, the fermentation broth was centrifuged at 3500 rpm for 10 minutes, 150 ul of fermentation supernatant was taken and filtered through a 0.2 um 96 well filter plate. The filtrate was analyzed for ethanol, sugar concentrations using Agilent HPLC system equipped with RI detector.

It is evident that all the beta-glucanases either individual or in combination of two or three improved ethanol yield when compared to baseline using 0.6 AGU/gDS Glucoamylase BL and 100 ug/gDS of CCA cellulases. Among the beta-glucanases tested in this study, Ta GH16 and SI GH16 are the best and the second best, respectively. Combining two or more beta-glucanases had even better ethanol yield improvement. As for different combinations, the mixture of GH16, GH5_15 and GH30_3 gave the highest ethanol yield. Beta-1,6-glucanase such as GH5_15 or GH30_3 and any beta 1,3(4)-glucanase such as SI GH16, Ta GH16, or Tr GH16 have shown very good ethanol boosting effect in SSF. In addition, exo-beta-1,3-glucanase GH55_3 combined with endo-beta-1,3(4) glucanase Tr GH16 also boosted ethanol yield.

Comparing to baseline using 0.6 AGU/gDS Glucoamylase BL and 100 ug/gDS of CCA, lower ethanol yield was observed when cellulase CCA was not added. On the other hand, further increase of cellulase CCA dose to 200 ug/g DS resulted in small increase of ethanol.

Example 32: Beta-Glucanase GH131 Improved Ethanol Yield in Simultaneous Saccharification and Fermentation (SSF)

This simultaneous saccharification and fermentation (SSF) study was performed with a liquefied corn mash. The corn mash used in this study was made from No2 yellow dent corn (midwestern USA) that has been processed sequentially by milling, jet cooking, and liquefying at 85 C for 2 hours with Alpha-amylase Blend X. The key enzyme activity in Alpha-amylase Blend X is provided by a thermostable alpha-amylase and a thermostable protease.

Several polypeptide beta-glucanases belong to family GH131 were from different organisms shown in Table 46 below. Each beta-glucanase was added on top of a base enzyme mix in this SSF laboratory study. The base enzyme mix consists of Glucoamylase BL2 and Cellulase CCB, The Glucoamylase BL2 and cellulase CCB were dosed at 0.42 AGU/g DS and 100 ug protein/g DS, respectively. In Glucoamylase BL2 the key enzyme activities are provided by glucoamylase that hydrolyzes (1,4)- and (1,6)-alpha-D-glucosidic linkages at the non-reducing ends of polysaccharides and a trehalase that hydrolyzes the (1,1)-alpha-D-glucosidic linkage in the disaccharide trehalose. cellulase CCB is a cellulase complex comprising of endoglucanase, cellobiohydrolyase and beta-glucosidase that hydrolyze cellulose coordinately to glucose.

TABLE 46

| Organism | GH family | Activity | SEQ ID NO |
|---|---|---|---|
| Coynascus sepedonium | GH131 | broad specificity on beta-1,3, beta-1,3/4, and/or beta-1,4-glucosidic linkages | SEQ ID NO: 44 |
| Aspergillus wentii | GH131 | broad specificity on beta-1,3, beta-1,3/4, and/or beta-1,4-glucosidic linkages | SEQ ID NO: 47 |
| Acrophialophora fusispora | GH131 | broad specificity on beta-1,3, beta-1,3/4, and/or beta-1,4-glucosidic linkages | SEQ ID NO: 50 |
| Acrophialophora fusispora | GH131 | broad specificity on beta-1,3, beta-1,3/4, and/or beta-1,4-glucosidic linkages | SEQ ID NO: 53 |
| Rhinocladiella sp. | GH131 | broad specificity on beta-1,3, beta-1,3/4, and/or beta-1,4-glucosidic linkages | SEQ ID NO: 56 |
| Nemania serpens | GH131 | broad specificity on beta-1,3, beta-1,3/4, and/or beta-1,4-glucosidic linkages | SEQ ID NO: 59 |
| Talaromyces leycettanus | GH131 | broad specificity on beta-1,3, beta-1,3/4, and/or beta-1,4-glucosidic linkages | SEQ ID NO: 62 |
| Collariella virescens | GH131 | broad specificity on beta-1,3, beta-1,3/4, and/or beta-1,4-glucosidic linkages | SEQ ID NO: 65 |
| Rigidoporus sp-74222 | GH131 | broad specificity on beta-1,3, beta-1,3/4, and/or beta-1,4-glucosidic linkages | SEQ ID NO: 68 |
| Loramyces macrosporus | GH131 | broad specificity on beta-1,3, beta-1,3/4, and/or beta-1,4-glucosidic linkages | SEQ ID NO: 71 |

In this SSF study, 500 ppm urea and 3 ppm penicillin were added into the liquefied corn mash. The corn mash pH was adjusted to 5.0. About 5 g prepared corn mash was then transferred into 15 ml tubes, and enzymes were pipetted in each tube according to the design of experiment (DOE) in Table 47 below. The SSF was carried out in triplicate of capped tubes in the presence of both enzymes and yeast yMHCT484, as described in WO 2018/222990 (which is hereby incorporated by reference herein in its entirety). The yeast yMHCT484 was a cream yeast. The yeast was diluted 4× with tap water at 32° C. for 30 minutes, the diluted yeast was added in SSF slurry at 10 ul/g corn slurry. The initial SSF conditions were 32% dry solid (DS) and pH5.0. The SSF was performed at 32° C. for 65 hours. Fermentation tubes were vortexed daily.

TABLE 47

| | Glucoamylase | Cellulase | GH131 beta-glucanase | |
|---|---|---|---|---|
| | BL2 (AGU/g DS) | CCB (ug/g DS) | (ug EP/g DS) | SEQ ID NO: |
| 1 | 0.42 | | | |
| 2 | 0.42 | 100 | | |
| 3 | 0.42 | 100 | 20 | SEQ ID NO: 44 |
| 4 | 0.42 | 100 | 20 | SEQ ID NO: 47 |
| 5 | 0.42 | 100 | 20 | SEQ ID NO: 50 |
| 6 | 0.42 | 100 | 20 | SEQ ID NO: 53 |
| 7 | 0.42 | 100 | 20 | SEQ ID NO: 56 |
| 8 | 0.42 | 100 | 20 | SEQ ID NO: 59 |
| 9 | 0.42 | 100 | 20 | SEQ ID NO: 62 |
| 10 | 0.42 | 100 | 20 | SEQ ID NO: 65 |
| 11 | 0.42 | 100 | 20 | SEQ ID NO: 68 |
| 12 | 0.42 | 100 | 20 | SEQ ID NO: 71 |

To stop the fermentation, about 50 ul 40% $H_2SO_4$ was added to each tube and vortexed at the end of SSF. The fermentation broth was centrifuged at 3500 rpm for 10 minutes, the supernatant was taken and filtered through a 0.2 um Whatman filter. The filtrate was analysed for ethanol and sugar concentrations using Agilent HPLC system equipped with RI detector. The ethanol concentration results are shown in Table 48 below. It is evident that all beta-glucanase mixtures improved or had at least the same ethanol yield in SSF on top of the base enzyme mix of Glucoamylase BL12 and Cellulase CCB.

TABLE 48

| | Label | Ethanol g/l | Ethanol % increase |
|---|---|---|---|
| 1 | Glucoamylase BL2 | 133.39 | 0.00% |
| 2 | Glucoamylase BL2 + Cellulase CCB | 133.43 | 0.03% |
| 3 | Glucoamylase BL2 + Cellulase CCB + SEQ ID NO: 44 | 134.26 | 0.65% |
| 4 | Glucoamylase BL2 + Cellulase CCB + SEQ ID NO: 47 | 134.26 | 0.65% |
| 5 | Glucoamylase BL2 + Cellulase CCB + SEQ ID NO: 50 | 133.54 | 0.11% |
| 6 | Glucoamylase BL2 + Cellulase CCB + SEQ ID NO: 53 | 133.56 | 0.13% |
| 7 | Glucoamylase BL2 + Cellulase CCB + SEQ ID NO: 56 | 133.63 | 0.18% |
| 8 | Glucoamylase BL2 + Cellulase CCB + SEQ ID NO: 59 | 133.82 | 0.32% |
| 9 | Glucoamylase BL2 + Cellulase CCB + SEQ ID NO: 62 | 133.57 | 0.13% |
| 10 | Glucoamylase BL2 + Cellulase CCB + SEQ ID NO: 65 | 133.59 | 0.15% |
| 11 | Glucoamylase BL2 + Cellulase CCB + SEQ ID NO: 68 | 134.47 | 0.81% |
| 12 | Glucoamylase BL2 + Cellulase CCB + SEQ ID NO: 71 | 134.85 | 1.09% |

Example 33: Mix of Beta-Glucanase GH131 and GH5_15 Improved Ethanol Yield in Simultaneous Saccharification and Fermentation (SSF)

This same liquefied corn mash in example 32 was used in this simultaneous saccharification and fermentation (SSF) study. The corn mash used in this study was made from No 2 yellow dent corn (midwestern USA) that has been processed sequentially by milling, jet cooking, and liquefying at 85 C for 2 hours with Alpha-amylase Blend X. The key enzyme activity in Alpha-amylase Blend X is a thermostable alpha-amylase and a thermostable protease.

A number of polypeptide beta-glucanases belong to family GH131 were from different organisms shown in Table 49 below. Each beta-glucanase was added on top of a base enzyme mix in this SSF laboratory study. The same base enzyme mix consisting of Glucoamylase BL2 and Cellulase CCB was used as in example 32. The Glucoamylase BL2 and Cellulase CCB were dosed at 0.42 AGU/g DS, 100 ug protein/g DS, respectively. In addition, a beta-glucanase GH5_15 (SEQ ID NO: 1) was also added together with each GH131 beta-glucanase and each beta-glucanase was dosed at 20 ug/g dry solid of corn slurry.

TABLE 49

| Organism | GH family | Activity | SEQ ID NO |
|---|---|---|---|
| Acrophialophora fusispora | GH131 | broad specificity on beta-1,3, beta-1,3/4, and/or beta-1,4-glucosidic linkages | SEQ ID NO: 50 |
| Rhinocladiella sp. | GH131 | broad specificity on beta-1,3, beta-1,3/4, and/or beta-1,4-glucosidic linkages | SEQ ID NO: 56 |
| Nemania serpens | GH131 | broad specificity on beta-1,3, beta-1,3/4, and/or beta-1,4-glucosidic linkages | SEQ ID NO: 59 |
| Talaromyces leycettanus | GH131 | broad specificity on beta-1,3, beta-1,3/4, and/or beta-1,4-glucosidic linkages | SEQ ID NO: 62 |
| Rigidoporus sp-74222 | GH131 | broad specificity on beta-1,3, beta-1,3/4, and/or beta-1,4-glucosidic linkages | SEQ ID NO: 68 |
| Corynascus sepedonium | GH131 | broad specificity on beta-1,3, beta-1,3/4, and/or beta-1,4-glucosidic linkages | SEQ ID NO: 74 |

SSF was performed similarly as in example 32. About 500 ppm urea and 3 ppm penicillin were added into the corn mash prior to pH adjustment About 5 g prepared corn mash was then transferred into 15 ml tubes, and enzymes were pipetted in each tube according to the design of experiment (DOE) in Table 50 below. The SSF was carried out in triplicate of capped tubes in the presence of both enzymes and yeast yMHCT484, as described in WO 2018/222990 (which is hereby incorporated by reference herein in its entirety). The yeast yMHCT84 was a cream yeast. The yeast was diluted 4× with tap water at 32° C. for 30 minutes prior to adding in SSF slurry at 10 ul/g corn slurry. The initial SSF conditions were 32% dry solid (DS) and pH5.0. The SSF was performed at 32° C. for 65 hours. Fermentation tubes were vortexed daily.

TABLE 50

| | Glucoamylase BL2 (AGU/g DS) | CCB Cellulase (ug/g DS) | GH5_15 beta-glucanase (SEQ ID NO: 2) (ug EP/gDS) | GH131 beta-glucanase (ug EP/g DS) | SEQ ID NO |
|---|---|---|---|---|---|
| 1 | 0.42 | 100 | | | |
| 2 | 0.42 | 100 | 20 | 20 | SEQ ID NO: 50 |
| 3 | 0.42 | 100 | 20 | 20 | SEQ ID NO: 56 |
| 4 | 0.42 | 100 | 20 | 20 | SEQ ID NO: 59 |
| 5 | 0.42 | 100 | 20 | 20 | SEQ ID NO: 62 |
| 6 | 0.42 | 100 | 20 | 20 | SEQ ID NO: 68 |
| 7 | 0.42 | 100 | 20 | 20 | SEQ ID NO: 74 |

To stop the fermentation, about 50 ul 40% H2SO4 was added to each tube and vortexed at the end of SSF. The fermentation broth was centrifuged at 3500 rpm for 10 minutes, the supernatant was taken and filtered through a 0.2 um Whatman filter. The filtrate was analysed for ethanol and sugar concentrations using Agilent HPLC system equipped with RI detector. The ethanol concentration results are shown in Table 51 below. It is evident that all beta-glucanase mixtures improved ethanol yield in SSF on top of base enzyme mix of Glucoamylase BL12+Cellulase CCB.

TABLE 51

| | Label | Ethanol g/l | Ethanol % increase |
|---|---|---|---|
| 1 | Glucoamylase BL2 + Cellulase CCB | 133.06 | 0.00% |
| 2 | Glucoamylase BL2 + Cellulase CCB + SEQ ID NO: 50 | 134.11 | 0.79% |

TABLE 51-continued

| Label | Ethanol g/l | Ethanol % increase |
|---|---|---|
| 3 Glucoamylase BL2 + Cellulase CCB + SEQ ID NO: 56 | 134.46 | 1.05% |
| 4 Glucoamylase BL2 + Cellulase CCB + SEQ ID NO: 59 | 134.82 | 1.32% |
| 5 Glucoamylase BL2 + Cellulase CCB + SEQ ID NO: 62 | 135.03 | 1.48% |
| 6 Glucoamylase BL2 + Cellulase CCB + SEQ ID NO: 68 | 134.38 | 0.99% |
| 7 Glucoamylase BL2 + Cellulase CCB + SEQ ID NO: 74 | 134.10 | 0.78% |

Example 34: β-Glucanase Hydrolysis of Fine Residuals from Corn Fermentation

After simultaneous saccharification and fermentation (SSF), there is still a residual fraction of fine particles, recalcitrant to hydrolysis and conversion. If a cellulolytic enzyme composition (as described above), and possibly also hemicellulases, are added to the SSF, then it is sometimes observed that the fraction of fine particles increases. The fine particles are potentially lost carbohydrates, and they sometimes also cause a problem in the evaporators of industrial plants, because they are not effectively separated by decanter centrifuges, and hence remain in the thin stillage fraction. When thin stillage is evaporated into syrup, elevated presence of fine particles may lead to elevated viscosity of the evaporated syrup, sometimes to a point where the flow in the evaporators is reduced or arrested.

In this example, fine particle substrate was recovered from SSF of liquefied corm mash in a 2 kg laboratory reactor. The liquefied corn mash was sourced from a commercial ethanol plant, and Alpha-Amylase 369 (AA369) was used for liquefaction. The SSF was run with Ethanol Red yeast, Glucoamylase BL2, CCB cellulase, Vinoflow Max A (an enzyme composition derived from *Trichoderma harzianum* containing native β-1,3-glucanase), and a glucuronoxylanase. After fermentation, ethanol was evaporated off the beer in a RotaVap rotary evaporator, water was added back to replace the ethanol and water that had been evaporated off, and the supernatant was separated from the insoluble fraction. The insoluble fraction was washed repeatedly with water, the fine particles were separated from the coarse particles on a 180 μm filter screen, and the fine particles were washed again after separation. The fine particle fraction was freeze dried. Later, a fraction of the fine particles was washed repeatedly again, autoclaved, and then washed again repeatedly. This is the fine particle substrate used for hydrolysis in this trial. It should be noted that, since Vinoflow was added to the SSF, any observed effects of β-glucanases in the subsequent hydrolysis assay go beyond what may have been accomplished by the native *T. harzianum* β-1,3-glucanase in Vinoflow.

The assay procedure was as follows. In a 96-well round bottom polypropylene microtiter plate, 100 μl of an aqueous (tap water) suspension containing 2% dry weight of the above described fine particle substrate was loaded into each well. Then, 100 μl of enzyme dilution in buffer (50 mM sodium acetate pH 5.0 with 0.01% Tween 20) was added to each well. The total enzyme dose was 100 pg enzyme protein per g substrate dry weight. The β-glucanase enzymes were substituted into CCB cellulase by 33%, such that 33% of the total enzyme protein was the β-glucanase being tested, and 67% was the cellulolytic composition. Samples with 100% cellulolytic composition were also included. Hence, increased response of the β-glucanase samples represents an improvement over the same amount of cellulolytic composition. The enzyme reaction was allowed to take place during incubation over night, where the sealed assay plates were placed in an Infors small-orbital incubator set to 600 RPM agitation speed and a temperature of 40° C. After incubation, the supernatant was transferred to a 0.2 μm filter plate, and filtered through this into a new plate by centrifugation. 60 μl filtered supernatant was transferred to a clear, flat bottom plate (NUNC brand). 20 μl 5N hydrochloric acid was added and mixed in, and the plate was sealed and incubated for 40 min. at 95° C. The purpose of this step was to hydrolyze oligomeric sugars to monomeric sugars, such that when reducing sugars were measured subsequently, the result represents the total amount of solubilized sugars in the supernatant. After the plate had cooled down for a few minutes, 20 μl sodium hydroxide (50% w/w solution, diluted four fold v/v) was added and mixed to neutralize the samples. To measure reducing sugar content, 100 μl of 1% p-Hydroxybenzoic acid hydrazide in 0.5 M sodium hydroxide solution was added and mixed in, and the plate was sealed and incubated for 15 minutes at 95° C. After cooling down, absorbance was measured at 410 nm wavelength. The absorbance is a relative measure for the amount of reducing sugar content in the supernatant samples, and samples were compared and ranked using this measurement.

A total of 14 enzymes were substituted into CCB cellulase, in six replicate observations randomly distributed across a 96-well microtiter plate. The remaining wells received 100% of the cellulolytic enzyme composition, and this treatment was denoted "None" (as in no enzyme substituted into the cellulolytic composition). Data was analyzed with JMP ver. 15.0.0 software from SAS Institute, and t treatments were compared by Tukey's HSD ranking procedure. Two treatments marked by the same letter(s) are not significantly different; two treatments not marked by any common letter(s) are significantly different, on 5% significance level.

TABLE 52

Enzymes tested.

| Abbreviation | SEQ ID NO: | Donor organism | Enzyme activity |
|---|---|---|---|
| Th GH64 | 11 | *Trichoderma harzianum* | Endo-1,3-beta-glucanase |
| Ta GH_5_15 | 38 | *Trichoderma atroviride* | Endo-1,6-beta-glucanase |
| Ta GH5_15 | 41 | *Trichoderma atroviride* | Endo-1,6-beta-glucanase |
| Fs GH5_15 | 77 | *Fusarium solani* | Endo-1,6-beta-glucanase |
| Gh GH30_3 2 | 80 | *Gilmaniella humicola* | Endo-beta-1,6-glucanase |
| Gm GH64 | 83 | *Gliomastix murorum* | Putative beta-1,3-glucanase |
| AvGH16 | 86 | *Albifimbria verrucaria* | Laminarinase |
| Ls GH16 | 89 | *Lecanicillium* sp. WMM742 | Laminarinase |
| Rb GH5_15 | 92 | *Rasamsonia byssochlamydoides* | Endo-1,6-beta-glucanase |

TABLE 52-continued

Enzymes tested.

| Abbreviation | SEQ ID NO: | Donor organism | Enzyme activity |
|---|---|---|---|
| Tl GH5_15 | 95 | Trichoderma longipile | Endo-1,6-beta-glucanase |
| Tk GH5_15 1 | 98 | Trichoderma koningiopsis | Endo-1,6-beta-glucanase |
| Tk GH5_15 2 | 101 | Trichoderma koningii | Endo-1,6-beta-glucanase |
| Ts GH5_15 | 104 | Trichoderma sinuosum | Endo-1,6-beta-glucanase |
| Th GH55_3 | 107 | Trichoderma harzianum | Endo-1,3-beta-glucanase |

TABLE 53

Test results ranked by Tukey's HSD procedure.

| Abbreviation | Letters | Mean | Std Error | Lower 95% | Upper 95% |
|---|---|---|---|---|---|
| Fs GH5_15 | A | 2.854 | 0.046 | 2.763 | 2.945 |
| RbGH5_15 | B | 2.529 | 0.046 | 2.438 | 2.620 |
| TaGH5_15 | B | 2.408 | 0.046 | 2.317 | 2.498 |
| AvGH16 | C | 1.960 | 0.046 | 1.869 | 2.050 |
| Gh GH30_3 2 | C | 1.931 | 0.046 | 1.840 | 2.022 |
| Tl GH5_15 | CD | 1.773 | 0.046 | 1.682 | 1.863 |
| Ls GH16 | D | 1.668 | 0.046 | 1.577 | 1.759 |
| Gm GH64 | E | 1.276 | 0.046 | 1.185 | 1.366 |
| Tk GH5_15 1 | E | 1.084 | 0.046 | 0.993 | 1.174 |
| Ts GH5_15 | E | 1.059 | 0.046 | 0.969 | 1.150 |
| Tk GH5_15 2 | F | 0.737 | 0.046 | 0.646 | 0.827 |
| Th GH64 | FG | 0.516 | 0.046 | 0.426 | 0.607 |
| Ta GH_5_15 | G | 0.462 | 0.046 | 0.372 | 0.553 |
| Th GH55_3 | G | 0.445 | 0.046 | 0.354 | 0.535 |
| None | G | 0.356 | 0.032 | 0.292 | 0.420 |

FIG. 1 shows test results ranked by Tukey's HSD procedure. As shown in FIG. 1, since the treatment "None" (No other enzymes substituted into the cellulolytic composition) is marked by the letter G, the top 11 enzymes, which are not marked by the letter G, showed a response that was significantly higher than 100% of the cellulolytic composition. Seven of these enzymes are β-1,6-glucanases from family GH5_15, two are laminarinases from family GH16, one is a β-1,6-glucanase from family GH30_3, and one is a β-1,3-glucanase from family GH64.

Example 35: Beta-Glucanase Improved Ethanol Yield in SSF of Corn Mash in the Presence of Cellulase Complex This simultaneous saccharification and fermentation (SSF) study was performed with a liquefied corn mash using purified beta-glucanases from the GH5_15, GH55_3, and GH64 families, including a GH5_15 family beta-glucanase from Trichoderma atroviride (the mature polypeptide of SEQ ID NO: 38 or SEQ ID NO: 39) and GH55_3 and GH64 family beta-glucanases from Trichoderma harzianum (the mature polypeptide of SEQ ID NO: 107 or SEQ ID NO: 108 and the mature polypeptide of SEQ ID NO: 11 or SEQ ID NO: 12, respectively). The corn mash used in this study was made from No2 yellow dent corn (midwestern USA) that has been processed at a commercial ethanol plant sequentially by milling, jet cooking, and liquefying using Alpha-amylase blend X at 85° C. for 2 hours.

Each beta-glucanase was added on top of a base enzyme mix in this SSF experiment. The base enzyme mix was a commercially available glucoamylase blend comprising Glucoamylase BL2 and Trehalase TF ("BL2TF"), and a cellulolytic composition CCB. The glucoamylase blend and cellulolytic composition were dosed at 0.60 AGU/g dry solid (DS), and 30 ug protein/g DS, respectively.

In this SSF study, 500 ppm urea and 3 ppm penicillin were added into the corn mash. The mash pH was adjusted to pH 5.0 at the beginning of SSF. About 4 grams of prepared corn mash was then transferred into 12 ml tubes, and enzymes were pipetted in each tube according to the design of experiment (DOE) in Table 54 below. The SSF was carried out in quadruplicate of capped tubes in the presence of both enzymes and the yeast MeJi797. The yeast was propagated by adding 50 μl yeast in 50 ml 6% YPD media and then incubated at 32° C. for 20 hours. The initial SSF conditions were 33.75% dry solid (DS) and 10 million yeast cells per gram of corn slurry. The SSF was performed at 32° C. for 64 hours. Fermentation tubes were vortexed daily.

To stop the fermentation, about 50 ul 40% $H_2SO4$ was added to each tube and vortexed at the end of SSF. After SSF, the fermentation tubes were centrifuged at 3500 rpm for 10 minutes, the supernatant was taken and filtered through a 0.2 μm syringe filter. The filtrate was analysed for ethanol and sugar concentrations using Agilent HPLC system equipped with RI detector.

The resulted ethanol yield in SSF was also shown in Table 54 below. Beta-glucanases from the GH5_15, GH55_3 and GH64 families individually or in combinations of two or three improved ethanol yield.

TABLE 54

Design of experiment and resulted ethanol yield after SSF

| | | Ta | Th | | Ethanol | | |
|---|---|---|---|---|---|---|---|
| BL2TF AGU/gDS | CCB ug/gDS | GH5_15 ug/gDS | GH55_3 ug/gDS | Th GH64 ug/gDS | Mean g/l | Std Err | % Improve |
| 0.6 | 30 | | | | 140.25 | 0.34 | 0.00% |
| 0.6 | 30 | | | 20 | 140.67 | 0.31 | 0.30% |
| 0.6 | 30 | | | 40 | 141.03 | 0.71 | 0.55% |
| 0.6 | 30 | | 20 | | 140.86 | 0.94 | 0.43% |
| 0.6 | 30 | 20 | | | 141.74 | 1.28 | 1.06% |
| 0.6 | 30 | 20 | 20 | | 140.99 | 0.71 | 0.53% |
| 0.6 | 30 | 20 | | 20 | 141.02 | 0.45 | 0.54% |
| 0.6 | 30 | 10 | 10 | 10 | 140.82 | 0.55 | 0.41% |

Example 36: Beta-Glucanase Improved Ethanol Yield in SSF of Corn Mash in the Presence of Beta-Glucosidase The same liquified corn mash as in Example 35 was used in this SSF study.

The purified beta-glucanases from the GH5_15, GH55_3, and GH64 families were the same as in Example 35. Beta-glucanases were added on top of a base enzyme mix in this SSF experiment. The base enzyme mix was a commercially available glucoamylase blend comprising Glucoamylase BL2 and Trehalase TF ("BL2TF"), and a purified monocomponent beta-glucosidase ("BG") from the cellulolytic composition CCB used in Example 35. The glucoamylase blend and beta-glucosidase were dosed at 0.60 AGU/g dry solid (DS) and 6 ug protein/g DS, respectively.

The SSF was performed the same as in Example 35 except enzyme addition (shown in Table 55 below). The ethanol analysis was the same as described in Example 35 and the results are shown in Table 55 below. Ethanol yield was improved by addition of beta-glucanases individually or in combinations in SSF in the presence of beta-glucosidase, illustrating that the beta-glucanases improve ethanol yield in the presence of individual cellulases.

TABLE 55

Design of experiment and resulted ethanol yield after SSF

| BL2TF AGU/gDS | BG ug/gDS | GH5_15 ug/gDS | Th GH55_3 ug/gDS | Th GH64 ug/gDS | Mean g/l | Std Err | % increase |
|---|---|---|---|---|---|---|---|
| 0.6 | 6 |    |    |    | 139.60 | 0.08 | 0.00% |
| 0.6 | 6 |    |    | 20 | 140.58 | 0.35 | 0.70% |
| 0.6 | 6 |    |    | 40 | 140.36 | 0.69 | 0.54% |
| 0.6 | 6 |    | 20 |    | 139.65 | 0.06 | 0.03% |
| 0.6 | 6 | 20 |    |    | 140.52 | 0.75 | 0.66% |
| 0.6 | 6 | 20 | 20 |    | 140.91 | 0.50 | 0.94% |
| 0.6 | 6 | 20 |    | 20 | 140.24 | 0.22 | 0.45% |
| 0.6 | 6 |    | 20 | 20 | 141.45 | 0.71 | 1.32% |
| 0.6 | 6 | 10 | 10 | 10 | 140.75 | 0.60 | 0.83% |

Example 37: Beta-Glucanase Improved Ethanol Yield in Simultaneous Saccharification and Fermentation (SSF) in the Presence of Cellulases This simultaneous saccharification and fermentation (SSF) study was performed with a liquefied corn mash. The corn mash used in this study was made from No2 yellow dent corn (midwestern USA) that has been processed sequentially by milling, jet cooking, and liquefying using Alpha-amylase Blend X at 85° C. for 2 hours. The corn mash was prepared in a commercial corn ethanol dry plant.

Purified versions of the mature polypeptides of the beta-glucanases from the GH5_15, GH303, GH553, and GH64 families as shown in Table 56 below were used in this example. Each beta-glucanase was added on top of a base enzyme mix in this SSF experiment. The base enzyme mix was a commercially available glucoamylase blend comprising Glucoamylase 1BL2 and Trehalase TF ("BL2TF"), and cellulolytic composition CCB and the purified beta-glucosidase ("BG") used in Example 36. The glucoamylase blend, cellulolytic composition and beta-glucosidase were dosed at 0.32 AGU/g DS, 30 ug protein/g DS, and 5 ug protein/g dry solid, respectively. An additional control using only the glucoamylase blend was also included in this SSF experiment.

TABLE 56

| Beta-glucanases | | | |
|---|---|---|---|
| Donor | Main Activity | GH Family | SEQ ID NO |
| Fusarium solani | Beta-1,6-glucan | GH5_15 | SEQ ID NO: 77 |
| Rasamsonia byssochlamydoides | Beta-1,6-glucan | GH5_15 | SEQ ID NO: 92 |
| Trichoderma atroviride | Beta-1,6-glucan | GH5_15 | SEQ ID NO: 38 |
| Gilmaniella humicola | Beta-1,6-glucan | GH30_3 | SEQ ID NO: 80 |
| Gliomastix murorum | Beta-1,3-glucan | GH64 | SEQ ID NO: 83 |
| Trichoderma harzianum | Beta-1,3-glucan | GH55_3 | SEQ ID NO: 107 |
| Albifimbria verrucaria | Beta-1,3(4)-glucan | GH16 | SEQ ID NO: 86 |

In this SSF study, 500 ppm urea and 3 ppm penicillin were added into the corn mash prior to pH adjustment. The start SSF pH was 5.0. About 4 grams of prepared corn mash was then transferred into 12 ml tubes, and enzymes were pipetted in each tube according to the design of experiment (DOE) in Table 57 below. The SSF was carried out in quadruplicate of capped tubes in the presence of both enzymes and the yeast MeJi797. The yeast was propagated by adding 50 ul yeast in 50 ml 6% YPD media and then incubated at 32° C. for 20 hours. The initial SSF conditions were 30.8% dry solid (DS) and pH 5.0 and 10 million yeast cells per gram of corn slurry. The SSF was performed at 32° C. for 64 hours. Fermentation tubes were vortexed daily.

To stop the fermentation, about 50 ul 40% $H_2SO_4$ was added to each tube and vortexed at the end of SSF. After SSF, the fermentation broth was centrifuged at 3500 rpm for 10 minutes, the supernatant was taken and filtered through a 0.2 μm WHATMAN filter. The filtrate was analysed for ethanol and sugar concentrations using AGILENT HPLC system equipped with RI detector.

The ethanol concentration results are shown in Table 57 below. It is evident that all beta-glucanases improved ethanol yield in SSF on top of the cellulolyitic composition and beta-glucosidase. The beta-glucanases are active on cleaving linkages of beta-1,6-glucan, beta-1,3-glucan, or beta-1,3(4)-glucan.

TABLE 57

DOE of SSF and ethanol yield

| BL2TF | CCB | BG | Beta-glucanase (40 ug/gDS) | Ethanol (g/l) | STDEV |
|---|---|---|---|---|---|
| 0.32 | | | | 125.5 | 0.175 |
| 0.32 | 30 | 5 | | 126.2 | 1.347 |
| 0.32 | 30 | 5 | SEQ ID NO: 77 | 126.6 | 0.799 |
| 0.32 | 30 | 5 | SEQ ID NO: 92 | 126.4 | 1.087 |
| 0.32 | 30 | 5 | SEQ ID NO: 38 | 127.5 | 0.572 |
| 0.32 | 30 | 5 | SEQ ID NO: 80 | 127.0 | 1.120 |
| 0.32 | 30 | 5 | SEQ ID NO: 83 | 126.5 | 0.896 |
| 0.32 | 30 | 5 | SEQ ID NO: 107 | 127.5 | 0.503 |
| 0.32 | 30 | 5 | SEQ ID NO: 86 | 127.0 | 0.782 |

Example 38: Beta-Glucanase Improved Ethanol Yield in SSF

This simultaneous saccharification and fermentation (SSF) study was performed with a liquefied corn mash. The corn mash used in this study was made from No2 yellow dent corn (midwestern USA) that has been processed at a commercial ethanol plant sequentially by milling, jet cooking, and liquefying using Alpha-Amylase Blend X at 85° C. for 2 hours.

Purified beta-glucanases from the GH5_15, GH16 and GH64 families as shown in Table 58 below were used in this example.

TABLE 58

Beta-glucanases

| Donor | GH Family | SEQ ID NO |
|---|---|---|
| Trichoderma atroviride | GH5_15 | SEQ ID NO: 38 |
| Aspergillus nidulans FGSC A4 | GH16 | SEQ ID NO: 144 |
| Trichoderma reesei | GH16 | SEQ ID NO: 23 |
| Trichoderma harzianum | GH16 | SEQ ID NO: 147 |
| Trichoderma atroviride | GH16 | SEQ ID NO: 26 |
| Trichoderma harzianum | GH64 | SEQ ID NO: 11 |

Each beta-glucanase was added on top of a base enzyme mix in this SSF experiment. The base enzyme mix was a commercially available glucoamylase blend comprising Glucoamylase BL2 and Trehalase TF ("BL2TF"), with or without cellulolytic composition CCB. The glucoamylase blend and cellulolytic composition were dosed at 0.42 AGU/g dry solid (DS) and 100 ug protein/g DS, respectively.

In this SSF study, 500 ppm urea and 3 ppm penicillin were added into the corn mash. The mash pH was adjusted to pH 5.0 at the beginning of SSF. About 4 grams of prepared corn mash was then transferred into 12 ml tubes, and enzymes were pipetted in each tube according to the design of experiment (DOE) in Table 59 below. The SSF was carried out in quadruplicate of capped tubes in the presence of both enzymes and the yeast yeasts MeJi797. The yeast was propagated by adding 50 µl yeast in 50 ml 6% YPD media and then incubated at 32° C. for 20 hours. The initial SSF conditions were 33.75% dry solid (DS) and 10 million yeast cells per gram of corn slurry. The SSF was performed at 32° C. for 64 hours. Fermentation tubes were vortexed daily.

To stop the fermentation, about 50 µl 40% $H_2SO_4$ was added to each tube and vortexed at the end of SSF. After SSF, the fermentation tubes were centrifuged at 3500 rpm for 10 minutes, the supernatant was taken and filtered through a 0.2 µm syringe filter. The filtrate was analysed for ethanol and sugar concentrations using AGILENT HPLC system equipped with RI detector.

The resulted ethanol yield in SSF was also show in Table 59 below. Beta-glucanases from the GH5_15, GH16 and GH64 families individually or in combinations improved ethanol yield regardless of the presence or absence of the cellulolytic composition. Many GH16 beta-glucanases and GH64 beta-glucanases were tested and all showed positive impact on ethanol yield in fermentation.

TABLE 59

DOE of SSF and ethanol yield

| BL2TF agu/gDS | Cellulolytic Composition CCB ug Protein/gDS | GH5_15 (ug/g DS) name | dose | GH16/GH64 (ug/gDS) name | dose | Ethanol Mean (g/l) | Std Err | % increase |
|---|---|---|---|---|---|---|---|---|
| 0.42 | 100 | | | | | 141.22 | 0.89 | 0.00 |
| 0.42 | 100 | SEQ ID NO: 38 | 40 | | | 141.72 | 0.62 | 0.36% |
| 0.42 | 100 | | | SEQ ID NO: 144 | 40 | 141.31 | 0.25 | 0.07% |
| 0.42 | 100 | | | SEQ ID NO: 23 | 40 | 141.36 | 0.65 | 0.10% |
| 0.42 | 100 | | | SEQ ID NO: 147 | 40 | 141.65 | 0.92 | 0.30% |
| 0.42 | 100 | | | SEQ ID NO: 26 | 40 | 141.97 | 0.74 | 0.54% |
| 0.42 | 100 | | | SEQ ID NO: 11 | 40 | 142.09 | 0.92 | 0.62% |
| 0.42 | 100 | SEQ ID NO: 38 | 20 | SEQ ID NO: 144 | 20 | 142.22 | 0.74 | 0.71% |
| 0.42 | 100 | SEQ ID NO: 38 | 20 | SEQ ID NO: 23 | 20 | 141.49 | 0.40 | 0.19% |
| 0.42 | 100 | SEQ ID NO: 38 | 20 | SEQ ID NO: 147 | 20 | 141.73 | 0.61 | 0.36% |
| 0.42 | 100 | SEQ ID NO: 38 | 20 | SEQ ID NO: 26 | 20 | 142.20 | 0.52 | 0.70% |
| 0.42 | 100 | SEQ ID NO: 38 | 20 | SEQ ID NO: 11 | 20 | 141.78 | 0.50 | 0.40% |
| 0.42 | | | | | | 139.72 | 0.76 | 0.00 |
| 0.42 | | SEQ ID NO: 38 | 40 | | | 141.20 | 0.82 | 1.06% |
| 0.42 | | | | SEQ ID NO: 144 | 40 | 140.79 | 0.66 | 0.77% |
| 0.42 | | | | SEQ ID NO: 147 | 40 | 141.77 | 0.33 | 1.47% |
| 0.42 | | | | SEQ ID NO: 23 | 40 | 140.49 | 0.32 | 0.55% |

TABLE 59-continued

DOE of SSF and ethanol yield

| Cellulolytic Composition CCB | | | GH5_15 (ug/g DS) | | GH16/GH64 (ug/gDS) | | Ethanol | | |
|---|---|---|---|---|---|---|---|---|---|
| BL2TF agu/gDS | ug Protein/gDS | name | dose | name | dose | Mean (g/l) | Std Err | % increase |
| 0.42 | | | | SEQ ID NO: 11 | 40 | 140.38 | 0.27 | 0.47% |
| 0.42 | | SEQ ID NO: 38 | 20 | SEQ ID NO: 144 | 20 | 141.67 | 0.59 | 1.40% |
| 0.42 | | SEQ ID NO: 38 | 20 | SEQ ID NO: 147 | 20 | 140.74 | 0.57 | 0.73% |
| 0.42 | | SEQ ID NO: 38 | 20 | SEQ ID NO: 23 | 20 | 140.86 | 0.75 | 0.82% |
| 0.42 | | SEQ ID NO: 38 | 20 | SEQ ID NO: 11 | 20 | 140.50 | 0.35 | 0.56% |

Example 39: Beta-Glucanase Improved Ethanol Yield in SSF

This simultaneous saccharification and fermentation (SSF) study was performed with a liquefied corn mash. The corn mash used in this study was made from No2 yellow dent corn (midwestern USA) that has been processed at a commercial ethanol plant sequentially by milling, jet cooking, and liquefying using Alpha-Amylase Blend X at 85° C. for 2 hours.

Purified beta-glucanases from the GH5_15, GH55, and GH64 families as shown in Table 60 below were used in this example.

TABLE 60

Beta-glucanases

| Donor | GH Family | SEQ ID NO |
|---|---|---|
| Trichoderma atroviride | GH5_15 | SEQ ID NO: 38 |
| Simplicillium lamellicola | GH55 | SEQ ID NO: 113 |
| Trichoderma harzianum | GH55_3 | SEQ ID NO: 107 |
| Hamigera inflate | GH55 | SEQ ID NO: 150 |
| Gliomastix murorum | GH64 | SEQ ID NO: 83 |
| Trichoderam harzianum | GH64 | SEQ ID NO: 11 |
| Acremonium exiguum | GH64 | SEQ ID NO: 153 |

Each beta-glucanase was added on top of a base enzyme mix in this SSF experiment.

The base enzyme mix was a commercially available glucoamylase blend comprising Glucoamylase BL2 and Trehalase TF ("BL2TF"), with or without cellulolytic composition CCB. The glucoamylase blend and the cellulolytic composition were dosed at 0.42 AGU/g dry solid (DS) and 100 ug protein/g DS, respectively.

In this SSF study, 500 ppm urea and 3 ppm penicillin were added into the corn mash. The mash pH was adjusted to pH 5.0 at the beginning of SSF. About 4 grams of prepared corn mash was then transferred into 12 ml tubes, and enzymes were pipetted in each tube according to the design of experiment (DOE) in Table 61 below. The SSF was carried out in quadruplicate of capped tubes in the presence of both enzymes and the yeast MeJi797. The yeast was propagated by adding 50 μl yeast in 50 ml 6% YPD media and then incubated at 32° C. for 20 hours. The initial SSF conditions were 34.25% dry solid (DS) and 10 million yeast cells per gram of corn slurry. The SSF was performed at 32° C. for 64 hours. Fermentation tubes were vortexed daily.

To stop the fermentation, about 50 μl 40% $H_2SO_4$ was added to each tube and vortexed at the end of SSF. After SSF, the fermentation tubes were centrifuged at 3500 rpm for 10 minutes, the supernatant was taken and filtered through a 0.2 μm syringe filter. The filtrate was analysed for ethanol and sugar concentrations using AGILENT HPLC system equipped with RI detector.

The resulted ethanol yield in SSF was also show in Table 61 below. Beta-glucanases GH5_15, GH55 and GH64 individually or in combinations improved ethanol yield in the presence of the cellulolytic composition. Many GH55 beta-glucanases and GH64 beta-glucanases were tested and all showed positive impact on ethanol yield in fermentation.

TABLE 61

DOE of SSF and ethanol yield (with celluololytic composition)

| BL2TF AGU/gDs | CCB ug/gDS | SEQ ID NO: 38 ug/gDS | b-1,3(4)-glucanase name | ug/gDS | Ethanol Mean g/l | % increase | Std Err |
|---|---|---|---|---|---|---|---|
| 0.42 | 100 | | | | 143.33 | 0.00% | 0.22 |
| 0.42 | 100 | 40 | | | 144.26 | 0.65% | 0.36 |
| 0.42 | 100 | | SEQ ID NO: 150 | 40 | 143.33 | 0.00% | 0.31 |
| 0.42 | 100 | 20 | SEQ ID NO: 150 | 20 | 145.07 | 1.21% | 0.29 |
| 0.42 | 100 | | SEQ ID NO: 113 | 40 | 143.63 | 0.21% | 0.74 |
| 0.42 | 100 | 20 | SEQ ID NO: 113 | 20 | 144.03 | 0.49% | 0.57 |
| 0.42 | 100 | | SEQ ID NO: 107 | 40 | 143.63 | 0.21% | 0.88 |
| 0.42 | 100 | 20 | SEQ ID NO: 107 | 20 | 144.49 | 0.81% | 0.62 |
| 0.42 | 100 | | SEQ ID NO: 11 | 40 | 143.68 | 0.25% | 0.52 |
| 0.42 | 100 | 20 | SEQ ID NO: 11 | 20 | 143.87 | 0.37% | 0.44 |
| 0.42 | 100 | | SEQ ID NO: 83 | 40 | 144.68 | 0.94% | 0.43 |
| 0.42 | 100 | 20 | SEQ ID NO: 83 | 20 | 145.20 | 1.30% | 0.29 |

When no cellulase complex WA was added in SSF, ethanol yield in SSF was also shown in Table 62 below. Beta-glucanases from the GH5_15, GH55 and GH64 families individually or in combinations improved ethanol yield in the absence of the cellulolytic composition. Many GH55 beta-glucanases and GH64 beta-glucanases were tested and all showed positive impact on ethanol yield in fermentation.

TABLE 62

DOE of SSF and ethanol yield (without cellulolytic composition)

| BL2TF | SEQ ID NO: 38 | β-1,3(4)-glucanase | | Ethanol | | |
|---|---|---|---|---|---|---|
| | | | | Mean | | |
| AGU/gDS | ug/gDS | name | ug/gDS | g/l | Std Err | % increase |
| 0.42 | | | | 142.34 | 0.51 | 0.00% |
| 0.42 | 40 | | | 142.41 | 0.67 | 0.05% |
| 0.42 | | SEQ ID NO: 150 | 40 | 143.81 | 0.72 | 1.03% |
| 0.42 | 20 | SEQ ID NO: 150 | 20 | 142.57 | 0.95 | 0.17% |
| 0.42 | | SEQ ID NO: 113 | 40 | 142.40 | 0.86 | 0.05% |
| 0.42 | 20 | SEQ ID NO: 113 | 20 | 143.23 | 0.71 | 0.63% |
| 0.42 | | SEQ ID NO: 107 | 40 | 142.37 | 0.63 | 0.02% |
| 0.42 | 20 | SEQ ID NO: 107 | 20 | 143.39 | 0.59 | 0.74% |
| 0.42 | | SEQ ID NO: 11 | 40 | 142.86 | 0.38 | 0.37% |
| 0.42 | 20 | SEQ ID NO: 11 | 20 | 144.58 | 0.14 | 1.57% |
| 0.42 | | SEQ ID NO: 153 | 40 | 143.00 | 0.98 | 0.46% |
| 0.42 | 20 | SEQ ID NO: 153 | 20 | 143.33 | 0.56 | 0.70% |
| 0.42 | | SEQ ID NO: 83 | 40 | 143.49 | 0.74 | 0.81% |
| 0.42 | 20 | SEQ ID NO: 83 | 20 | 143.24 | 0.38 | 0.64% |

Example 40: Construction of Yeast Strains Expressing a Single Beta-Glucosidase This example describes the construction of yeast cells containing a beta-glucosidase under the control of one *S. cerevisiae* constitutive promoter pTDH3. Three pieces of DNA containing the promoter, gene, and terminator were designed to allow for homologous recombination between the 3 fragments into the XII-2 locus of the yeast MeJi797 (See, WO2020/076697). The resulting strains have one pTDH3 promoter containing fragment (left fragment), one beta-glucosidase gene containing fragment (middle fragment), and one PRM9 terminator fragment (right fragment) integrated into the *S. cerevisiae* genome at the XII-2 locus.
Construction of the Promoter TDH3 Containing Fragment (Left Fragment)

The linear DNA containing 500 bp homology to the XII-2 site and the *S. cerevisiae* pTDH3 promoter was PCR amplified from HP30 plasmid DNA. Fifty pmoles each of forward and reverse primer was used in a PCR reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 µL. The PCR was performed in a T100™ Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 2.5 minutes with a final extension at 72° C. for 5 minutes. Following thermocycling, the PCR reaction products gel isolated and cleaned up using the QIAquick Gel and PCR clean-up kit (Qiagen).
Construction of the Beta-Glucosidase Containing Fragment (Middle Fragment)

Synthetic linear uncloned DNA containing the EXG1 signal peptide, beta-glucosidase gene (encoding the *Aspergillus fumigatus* variant beta-glucosidase disclosed in SEQ ID NO: 122 with the following substitutions: F100D, S283G, N456E, F512Y) and 50 bp of the PRM9 terminator was ordered from GeneArt. The linear DNA containing 50 bp homology to the *S. cerevisiae* pTDH3 promoter was PCR amplified from the synthetic cloned gene using fifty pmoles each of forward and reverse primer in a PCR reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 µL. The PCR was performed in a T100™ Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 55 minutes with a final extension at 72° C. for 5 minutes. Following thermocycling, the PCR reaction products gel isolated and cleaned up using the QIAquick Gel and PCR clean-up kit (Qiagen).
Construction of the Terminator Contain Fragment (Right Fragment)

The DNA containing 250 bp of the PRM9 terminator and 500 bp of the XII-2 3'end homology was PCR amplified from TH12 plasmid DNA using fifty pmoles each of forward and reverse primer in a PCR reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 µL. The PCR was performed in a T100M Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 2.5 minutes with a final extension at 72° C. for 5 minutes. Following thermocycling, the PCR reaction products gel isolated and cleaned up using the QIAquick Gel and PCR clean-up kit (Qiagen).
Integration of the Left, Middle and Right-Hand Fragments to Generate Yeast Strains Expressing a Beta-Glucosidase The yeast MeJi797 was transformed with the left, middle and right integration fragments described above. In each transformation pool, the two left fragments and right fragment with 50 ng of each fragment was used. There was one set of the left and right fragment pool used: for pTDH3. The middle fragment consisted of the EXG1 signal peptide and beta-glucosidase gene with ~50 ng of each fragment (200 ng total). To aid homologous recombination of the left, middle and right fragments at the genomic XII-2 sites a plasmid containing MAD7 and guide RNA specific to XII-2 (pMIBa638) was also used in the transformation. These three components were transformed into the *S. cerevisiae* strain MeJi797 following a yeast electroporation protocol. Transformants were selected on YPD+cloNAT to select for transformants that contain the Mad7 plasmid pMIBa638. Transformants were either picked manually by hand onto YPD plates or by using a Q-pix Colony Picking System (Molecular Devices) to inoculate 1 well of 96-well plate containing YPD media. The plates were grown for 2 days then glycerol was added to 20% final concentration and the plates were stored at −80° C. until needed. Integration of specific beta-glucosidase construct was verified by PCR with locus specific primers and subsequent sequencing. The strains generated in this example were named S709-A06, S709-B06, S709-C06 and S709-D06.

Example 41: Construction of Yeast Strains Expressing a Single Beta-Glucanase

This example describes the construction of yeast cells containing a beta-glucanase gene under the control of one of four *S. cerevisiae* promoters: PGK1 (a medium strength constitutive), RPL18B (a lower strength constitutive), HOR7 (anaerobic) and DAN1 (anaerobic). Three pieces of DNA containing the promoter, gene and terminator were designed to allow for homologous recombination between the four DNA fragments and into either the XII-2 or X-3 loci of the yeast MeJi797 or S709-A06 (supra). The resulting strains have one promoter containing fragment (left fragment), one gene containing fragment (middle fragment) and one PRM9 terminator fragment (right fragment) integrated into the *S. cerevisiae* genome at the XII-2 or X-3 locus.

Construction of the Promoter HOR7 Containing Fragments (2 Left Fragments)

The linear DNA containing 500 bp homology to the XII-2 site and the *S. cerevisiae* pHOR7 promoter was PCR amplified from HP39 plasmid DNA using fifty pmoles each of forward and reverse primer in a reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 μL. The PCR was performed in a T100M Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 2.5 minutes with a final extension at 72° C. for 5 minutes. Following thermocycling, the PCR reaction products gel isolated and cleaned up using the QIAquick Gel Extraction kit (Qiagen).

The linear DNA containing 249 bp homology to the *S. cerevisiae* pHOR7 promoter and the TS signal peptide was PCR amplified from the 19AALWKW DNA piece synthesized by GeneArt (pHOR7_TsSP). Fifty pmoles each of forward and reverse primer was used in a PCR reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 μL. The PCR was performed in a T100M Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 2.5 minutes with a final extension at 72° C. for 5 minutes. Following thermocycling, the PCR reaction products gel isolated and cleaned up using the QIAquick Gel and PCR clean-up kit (Qiagen).

Construction of the Promoter DAN1 Containing Fragments (2 Left Fragments)

The linear DNA containing 500 bp homology to the XII-2 site and the *S. cerevisiae* pDAN1 promoter was PCR amplified from HP37 plasmid DNA using fifty pmoles each of forward and reverse primer in a reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 μL. The PCR was performed in a T100m Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 2.5 minutes with a final extension at 72° C. for 5 minutes. Following thermocycling, the PCR reaction products gel isolated and cleaned up using the QIAquick Gel Extraction kit (Qiagen).

The linear DNA containing 249 bp homology to the *S. cerevisiae* pDAN1 promoter and the TS signal peptide was PCR amplified from 19AALWLW DNA piece synthesized by GeneArt (pDAN1_TsSP). Fifty pmoles each of forward and reverse primer was used in a PCR reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 μL. The PCR was performed in a T100m Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 2.5 minutes with a final extension at 72° C. for 5 minutes. Following thermocycling, the PCR reaction products gel isolated and cleaned up using the QIAquick Gel and PCR clean-up kit (Qiagen).

Construction of the Promoter RPL18B Containing Fragments (2 Left Fragments)

The linear DNA containing 500 bp homology to the XII-2 site and the *S. cerevisiae* pRPL18B promoter was PCR amplified using fifty pmoles each of forward and reverse primer in a reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 μL. The PCR was performed in a T100m Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 2.5 minutes with a final extension at 72° C. for 5 minutes. Following thermocycling, the PCR reaction products gel isolated and cleaned up using the QIAquick Gel Extraction kit (Qiagen).

The linear DNA containing 249 bp homology to the *S. cerevisiae* pRPL18B promoter and the TS signal peptide was PCR amplified from the 19AALWMW DNA piece (pRPL18B_TSsp) synthesized by GeneArt. Fifty pmoles each of forward and reverse primer was used in a PCR reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 μL. The PCR was performed in a T100m Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 2.5 minutes with a final extension at 72° C. for 5 minutes. Following thermocycling, the PCR reaction products gel isolated and cleaned up using the QIAquick Gel and PCR clean-up kit (Qiagen).

Construction of the Promoter PGK1 Containing Fragments (1 Left Fragment)

The linear DNA containing 500 b homology to the X-3 site and the *S. cerevisiae* pPGK1 promoter was PCR amplified from HP1 plasmid DNA using fifty pmoles each of forward and reverse primer was used in a PCR reaction containing 5 ng of plasmid DNA as template, 1× Platinum Superfi HF Buffer (Thermo Fisher Scientific), and 2 units SuperFi DNA polymerase in a final volume of 50 µL. The PCR was performed in a T100™ Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Beta-Glucanase Containing Fragments (Middle Fragments)

Synthetic linear uncloned DNA containing the TS signal peptide, beta-glucanase gene and 50 bp of the PRM9 terminator was ordered from the vendor as indicated in Table 63.

TABLE 63

| Donor Organism | Synthetic DNA supplier | GH family | Activity/SEQ ID NO |
|---|---|---|---|
| *Trichoderma harzianum* | GeneArt | GH55_3 | exo-ß-1,3-glucanase SEQ ID NO: 5 |
| *Trichoderma atroviride* | GeneArt | GH55_3 | endo-ß-1,3-glucanase SEQ ID NO: 116 |
| *Trichoderma harzianum* | GeneArt | GH55_3 | endo-ß-1,3-glucanase SEQ ID NO: 107 |
| *Trichoderma harzianum* | GeneArt | GH55_3 | endo-ß-1,3-glucanase SEQ ID NO: 108 |
| *Trichoderma atroviride* | GeneArt | GH55_3 | endo-ß-1,3-glucanase SEQ ID NO: 110 |
| *Simplicillium lamellicola* | GeneArt | GH55_3 | endo-ß-1,3-glucanase SEQ ID NO: 113 |
| *Simplicillium lamellicola* | Twist | GH5_15 | endo-ß-1,6-glucanase SEQ ID NO: 35 |
| *Trichoderma atroviride* | Twist | GH5_15 | endo-ß-1,6-glucanase SEQ ID NO: 38 |
| *Simplicillium lamellicola* | Twist | GH64 | endo-ß-1,3-glucanase/ SEQ ID NO: 17 |
| *Trichoderma atroviride* | Twist | GH5_15 | endo-ß-1,6-glucanase SEQ ID NO: 41 |
| *Trichoderma harzianum* | Twist | GH5_15 | endo-ß-1,6-glucanase/ SEQ ID NO: 2 |
| *Trichoderma harzianum* | Twist | GH64 (A99) | endo-ß-1,3-glucanase SEQ ID NO: 8 |
| *Trichoderma atroviride* | Twist | GH30_3 | endo-ß-1,6-glucanase SEQ ID NO: 119 |
| *Trichoderma harzianum* | Twist | GH30_3 | endo-ß-1,6-glucanase SEQ ID NO: 32 |
| *Simplicillium lamellicola* | Twist | GH16 | endo-ß-1,3(4)-glucanase SEQ ID NO: 20 |
| *Trichoderma Reesei* | Twist | GH16 | endo-ß-1,3(4)-glucanase SEQ ID NO: 23 |
| *Trichoderma harzianum* | Twist | GH64 | endo-ß-1,3-glucanase/ SEQ ID NO: 11 |

Additional synthetic linear uncloned DNA containing the pPGK1 promoter, TS signal peptide, beta-glucanase gene, and 50 bp of the PRM9 terminator were ordered from the vendor as indicated in Table 64.

TABLE 64

| Donor Organism | Synthetic DNA supplier | GH family | Activity/SEQ ID NO |
|---|---|---|---|
| *Rhinocladiella* sp. | Twist | GH131 | broad specificity on beta-1,3, beta-1,3/4, and/or beta-1,4-glucosidic linkages SEQ ID NO: 56 |
| *Nemania serpens* | Twist | GH131 | broad specificity on beta-1,3, beta-1,3/4, and/or beta-1,4-glucosidic linkages SEQ ID NO: 59 |
| *Talaromyces leycettanus* | Twist | GH131 | broad specificity on beta-1,3, beta-1,3/4, and/or beta-1,4-glucosidic linkages SEQ ID NO: 62 |
| *Acrophialophora fusispora* | Twist | GH131 | broad specificity on beta-1,3, beta-1,3/4, and/or beta-1,4-glucosidic linkages SEQ ID NO: 50 |
| *Rigidoporus* sp. | Twist | GH131 | broad specificity on beta-1,3, beta-1,3/4, and/or beta-1,4-glucosidic linkages SEQ ID NO: 68 |

Construction of the Terminator Contain Fragment (Right Fragment)

The DNA containing 250 bp of the PRM9 terminator and 500 bp of the XII-2 3'end homology was PCR amplified from TH12 plasmid DNA using fifty pmoles each of forward and reverse primer in a reaction containing 5 ng of plasmid DNA as template, 0.1 mM each dATP, dGTP, dCTP, dTTP, 1× Phusion HF Buffer (Thermo Fisher Scientific), and 2 units Phusion DNA polymerase in a final volume of 50 µL. The PCR was performed in a T100m Thermal Cycler (Bio-Rad Laboratories, Inc.) programmed for one cycle at 98° C. for 3 minutes followed by 32 cycles each at 98° C. for 20 seconds, 60° C. for 20 seconds, and 72° C. for 2.5 minutes with a final extension at 72° C. for 5 minutes. Following thermocycling, the PCR reaction products gel isolated and cleaned up using the QIAquick Gel and PCR clean-up kit (Qiagen).

Additional DNA containing 250 bp of the PRM9 terminator and 500 bp of the X-3 3'end homology was PCR amplified from the TH37 plasmid DNA using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 µL. The PCR was performed in a T100m Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel and PCR clean-up kit (Qiagen).

Integration of the Left. Middle and Right-Hand Fragments to Generate Yeast Strains with a Beta-Glucanase The yeast MeJi797 was transformed with the left, middle and right integration fragments described above. In each transformation pool, the two left fragments and right fragment with 50 ng of each fragment was used. There were three sets of the two left and one right fragment pools used: for pHOR7, pDAN1, and pRPL18B. The middle fragment consisted of a signal peptide and beta-glucanase gene with ~50 ng of each fragment (200 ng total). To aid homologous recombination of the left, middle and right fragments at the genomic XII-2 sites a plasmid containing MAD7 and guide RNA specific to XII-2 (pMIBa638) was also used in the transformation. These four components were transformed into the *S. cerevisiae* strain MeJi797 following a yeast electroporation protocol. Transformants were selected on YPD+cloNAT to select for transformants that contain the Mad7 plasmid pMIBa638. Transformants were either picked manually by hand onto YPD plates or by using a Q-pix Colony Picking System (Molecular Devices) to inoculate 1 well of 96-well plate containing YPD media. The plates were grown for 2 days then glycerol was added to 20% final concentration and the plates were stored at −80° C. until needed. Integration of specific beta-glucanase construct was verified by PCR with locus specific primers and subsequent sequencing.

Additional yeast MeJi797 or S709-A06 was transformed with the left, middle and right integration fragments described above. In each transformation pool, the one left fragment and right fragment with 50 ng of each fragment was used. There was one set containing one left and one right garment pool used: for pPGK1. The middle fragment consisted of the pPGK1 promoter, a signal peptide, and beta-glucanase gene with ~50 ng of each fragment (200 ng total). To aid homologous recombination of the left, middle and right fragments at the genomic X-3 sites, a plasmid containing MAD7 and guide RNA specific to X-3 (pMIBa647) was also used in the transformation. These 3 components were transformed into the *S. cerevisiae* strain MeJi797 or S709-A06 following a yeast electroporation protocol. Transformants were selected on YPD+cloNAT to select for transformants that contain the Mad7 plasmid pMIBa647. Transformants were either picked manually by hand onto YPD plates or by using a Q-pix Colony Picking System (Molecular Devices) to inoculate 1 well of 96-well plate containing YPD meda. The plates were grown for 2 days then glycerol was added to 20% final concentration and the plates were stored at −80° C. until needed. Integration of specific beta-glucanase construct was verified by PCR with locus specific primers and subsequent sequencing. The strains generated in the MeJi797 background in this example are shown in Table 65, and the strains generated in the S709-A06 background in this example are shown in Table 66.

TABLE 65

Strains with beta-glucanase expressed from MeJi797 background strain

| Strain ID | Donor Organism | Promoter | GH family | Activity/SEQ ID NO |
|---|---|---|---|---|
| MeJi797 | — | — | — | — |
| S686-A01 | Simplicillium lamellicola | pHOR7 | GH5_15 | endo-ß-1,6-glucanase SEQ ID NO: 35 |
| S686-G01 | Trichoderma atroviride | pHOR7 | GH5_15 | endo-ß-1,6-glucanase SEQ ID NO: 38 |
| S686-A05 | Trichoderma harzianum | pHOR7 | GH5_15 | endo-ß-1,6-glucanase SEQ ID NO: 2 |
| S686-D05 | Trichoderma harzianum | pHOR7 | GH5_15 | endo-ß-1,6-glucanase SEQ ID NO: 2 |
| S686-E05 | Trichoderma harzianum | pHOR7 | GH64 (A99) | endo-ß-1,3-glucanase SEQ ID NO: 8 |
| S686-H05 | Trichoderma harzianum | pHOR7 | GH64 (A99) | endo-ß-1,3-glucanase SEQ ID NO: 8 |
| S686-B06 | Trichoderma atroviride | pHOR7 | GH30_3 | endo-ß-1,6-glucanase SEQ ID NO: 119 |

TABLE 65-continued

Strains with beta-glucanase expressed from MeJi797 background strain

| Strain ID | Donor Organism | Promoter | GH family | Activity/SEQ ID NO |
|---|---|---|---|---|
| S686-A09 | Simplicillium lamellicola | pHOR7 | GH16 | endo-ß-1,3(4)-glucanase SEQ ID NO: 20 |
| S686-F09 | Trichoderma Reesei | pHOR7 | GH16 | endo-ß-1,3(4)-glucanase SEQ ID NO: 23 |
| S686-A10 | Trichoderma harzianum | pHOR7 | GH64 | endo-ß-1,3-glucanase SEQ ID NO: 11 |
| S715-H02 | Trichoderma harzianum | pHOR7 | GH55_3 | endo-ß-1,3-glucanase SEQ ID NO: 107 |
| S715-F03 | Trichoderma atroviride | pHOR7 | GH55_3 | endo-ß-1,3-glucanase SEQ ID NO: 116 |
| S715-G03 | Trichoderma atroviride | pHOR7 | GH55_3 | endo-ß-1,3-glucanase SEQ ID NO: 116 |
| S686-G10 | Simplicillium lamellicola | pDAN1 | GH5_15 | endo-ß-1,6-glucanase SEQ ID NO: 35 |
| S686-H10 | Simplicillium lamellicola | pDAN1 | GH5_15 | endo-ß-1,6-glucanase SEQ ID NO: 35 |
| S687-H01 | Simplicillium lamellicola | pDAN1 | GH64 | endo-ß-1,3-glucanase SEQ ID NO: 17 |
| S687-F02 | Trichoderma harzianum | pDAN1 | GH5_15 | endo-ß-1,6-glucanase SEQ ID NO: 2 |
| S687-D05 | Trichoderma harzianum | pDAN1 | GH64 (A99) | endo-ß-1,3-glucanase SEQ ID NO: 8 |
| S687-F05 | Trichoderma atroviride | pDAN1 | GH30_3 | endo-ß-1,6-glucanase SEQ ID NO: 119 |
| S687-H05 | Trichoderma atroviride | pDAN1 | GH30_3 | endo-ß-1,6-glucanase SEQ ID NO: 119 |
| S687-B06 | Trichoderma harzianum | pDAN1 | GH30_3 | endo-ß-1,6-glucanase SEQ ID NO: 32 |
| S687-G06 | Simplicillium lamellicola | pDAN1 | GH16 | endo-ß-1,3(4)-glucanase SEQ ID NO: 20 |
| S687-B09 | Trichoderma Reesei | pDAN1 | GH16 | endo-ß-1,3(4)-glucanase SEQ ID NO: 23 |
| S687-E09 | Trichoderma harzianum | pDAN1 | GH64 | endo-ß-1,3-glucanase SEQ ID NO: 11 |
| S687-H09 | Trichoderma harzianum | pDAN1 | GH64 | endo-ß-1,3-glucanase SEQ ID NO: 11 |
| S715-G05 | Trichoderma harzianum | pDAN1 | GH55_3 | endo-ß-1,3-glucanase SEQ ID NO: 107 |
| S687-A10 | Simplicillium lamellicola | pRPL18B | GH5_15 | endo-ß-1,6-glucanase SEQ ID NO: 35 |
| S687-C10 | Simplicillium lamellicola | pRPL18B | GH5_15 | endo-ß-1,6-glucanase SEQ ID NO: 35 |
| S686-B03 | Simplicillium lamellicola | pRPL18B | GH64 | endo-ß-1,3-glucanase SEQ ID NO: 17 |
| S686-F03 | Trichoderma atroviride | pRPL18B | GH5_15 | endo-ß-1,6-glucanase SEQ ID NO: 41 |
| S686-G03 | Trichoderma atroviride | pRPL18B | GH5_15 | endo-ß-1,6-glucanase SEQ ID NO: 41 |
| S686-A04 | Trichoderma harzianum | pRPL18B | GH5_15 | endo-ß-1,6-glucanase SEQ ID NO: 2 |

TABLE 65-continued

Strains with beta-glucanase expressed from MeJi797 background strain

| Strain ID | Donor Organism | Promoter | GH family | Activity/SEQ ID NO |
|---|---|---|---|---|
| S686-H04 | Trichoderma harzianum | pRPL18B | GH64 (A99) | endo-ß-1,3-glucanase SEQ ID NO: 8 |
| S686-C07 | Trichoderma atroviride | pRPL18B | GH30_3 | endo-ß-1,6-glucanase SEQ ID NO: 119 |
| S686-E07 | Trichoderma harzianum | pRPL18B | GH30_3 | endo-ß-1,6-glucanase SEQ ID NO: 32 |
| S686-F07 | Trichoderma harzianum | pRPL18B | GH30_3 | endo-ß-1,6-glucanase SEQ ID NO: 32 |
| S686-A08 | Simplicillium lamellicola | pRPL18B | GH16 | endo-ß-1,3(4)-glucanase SEQ ID NO: 20 |
| S686-D08 | Simplicillium lamellicola | pRPL18B | GH16 | endo-ß-1,3(4)-glucanase SEQ ID NO: 20 |
| S686-E08 | Trichoderma Reesei | pRPL18B | GH16 | endo-ß-1,3(4)-glucanase SEQ ID NO: 23 |
| S686-G08 | Trichoderma Reesei | pRPL18B | GH16 | endo-ß-1,3(4)-glucanase SEQ ID NO: 23 |
| 8686-A11 | Trichoderma harzianum | pRPL18B | GH64 | endo-ß-1,3-glucanase SEQ ID NO: 11 |
| S715-E08 | Trichoderma harzianum | pRPL18B | GH55_3 | endo-ß-1,3-glucanase SEQ ID NO: 107 |
| S715-A07 | Simplicillium lamellicola | pRPL18B | GH55_3 | endo-ß-1,3-glucanase SEQ ID NO: 113 |
| S715-C08 | Trichoderma harzianum | pRPL18B | | SEQ ID NO: 108 |
| S798-E11 | Rhinocladiella sp. | pPGK1 | GH131 | broad specificity on beta-1,3, beta-1,3/4, and/or beta-1,4-glucosidic linkages SEQ ID NO: 56 |
| S798-F11 | Rhinocladiella sp. | pPGK1 | GH131 | broad specificity on beta-1,3, beta-1,3/4, and/or beta-1,4-glucosidic linkages SEQ ID NO: 56 |
| S798-G11 | Rhinocladiella sp. | pPGK1 | GH131 | broad specificity on beta-1,3, beta-1,3/4, and/or beta-1,4-glucosidic linkages SEQ ID NO: 56 |
| S798-H11 | Rhinocladiella sp. | pPGK1 | GH131 | broad specificity on beta-1,3, beta-1,3/4, and/or beta-1,4-glucosidic linkages SEQ ID NO: 56 |
| S799-A03 | Nemania serpens | pPGK1 | GH131 | broad specificity on beta-1,3, beta-1,3/4, and/or beta-1,4-glucosidic linkages SEQ ID NO: 59 |
| S799-B03 | Nemania serpens | pPGK1 | GH131 | broad specificity on beta-1,3, beta-1,3/4, and/or beta-1,4-glucosidic linkages SEQ ID NO: 59 |
| S799-E03 | Talaromyces leycettanus | pPGK1 | GH131 | broad specificity on beta-1,3, beta-1,3/4, and/or beta-1,4-glucosidic linkages SEQ ID NO: 62 |
| S799-F03 | Talaromyces leycettanus | pPGK1 | GH131 | broad specificity on beta-1,3, beta-1,3/4, and/or beta-1,4-glucosidic linkages SEQ ID NO: 62 |
| S799-A04 | Acrophialophora fusispora | pPGK1 | GH131 | broad specificity on beta-1,3, beta-1,3/4, and/or beta-1,4-glucosidic linkages SEQ ID NO: 50 |
| S799-C04 | Acrophialophora fusispora | pPGK1 | GH131 | broad specificity on beta-1,3, beta-1,3/4, and/or beta-1,4-glucosidic linkages SEQ ID NO: 50 |
| S799-D04 | Acrophialophora fusispora | pPGK1 | GH131 | broad specificity on beta-1,3, beta-1,3/4, and/or beta-1,4-glucosidic linkages SEQ ID NO: 50 |
| S799-E04 | Rigidoporus sp. | pPGK1 | GH131 | broad specificity on beta-1,3, beta-1,3/4, and/or beta-1,4-glucosidic linkages SEQ ID NO: 68 |
| S799-G04 | Rigidoporus sp. | pPGK1 | GH131 | broad specificity on beta-1,3, beta-1,3/4, and/or beta-1,4-glucosidic linkages SEQ ID NO: 68 |
| S799-H04 | Rigidoporus sp. | pPGK1 | GH131 | broad specificity on beta-1,3, beta-1,3/4, and/or beta-1,4-glucosidic linkages SEQ ID NO: 68 |

TABLE 66

Strains with beta-glucanase expressed from S709-A06 background strain.

| Strain ID | Donor Organism | promoter | Donor Organism | Activity/SEQ ID NO |
|---|---|---|---|---|
| S709-A06 | — | — | — | — |
| S796-E09 | Rhinocladiella sp. | pPGK1 | GH131 | broad specificity on beta-1,3, beta-1,3/4, and/or beta-1,4-glucosidic linkages SEQ ID NO: 56 |
| S796-G09 | Rhinocladiella sp. | pPGK1 | GH131 | broad specificity on beta-1,3, beta-1,3/4, and/or beta-1,4-glucosidic linkages SEQ ID NO: 56 |

TABLE 66-continued

Strains with beta-glucanase expressed from S709-A06 background strain.

| Strain ID | Donor Organism | promoter | Donor Organism | Activity/SEQ ID NO |
|---|---|---|---|---|
| S796-H09 | Rhinocladiella sp. | pPGK1 | GH131 | broad specificity on beta-1,3, beta-1,3/4, and/or beta-1,4-glucosidic linkages SEQ ID NO: 56 |
| S797-A01 | Nemania serpens | pPGK1 | GH131 | broad specificity on beta-1,3, beta-1,3/4, and/or beta-1,4-glucosidic linkages SEQ ID NO: 59 |
| S797-E01 | Talaromyces leycettanus | pPGK1 | GH131 | broad specificity on beta-1,3, beta-1,3/4, and/or beta-1,4-glucosidic linkages SEQ ID NO: 62 |
| S797-B02 | Acrophialophora fusispora | pPGK1 | GH131 | broad specificity on beta-1,3, beta-1,3/4, and/or beta-1,4-glucosidic linkages SEQ ID NO: 50 |
| S797-D02 | Acrophialophora fusispora | pPGK1 | GH131 | broad specificity on beta-1,3, beta-1,3/4, and/or beta-1,4-glucosidic linkages SEQ ID NO: 50 |
| S797-H02 | Rigidoporus sp. | pPGK1 | GH131 | broad specificity on beta-1,3, beta-1,3/4, and/or beta-1,4-glucosidic linkages SEQ ID NO: 68 |

Example 42: Fermentation Performance of Yeast Strains Expressing a Single Beta-Glucanase This example describes the evaluation of yeast strains expressing a single beta-glucanase on final ethanol titer in a corn mash fermentation.

Preparation of Yeast Culture for Tube Fermentations

Yeast strains (supra) were incubated overnight in YPD media (6% w/v D-glucose, 2% peptone, 1% yeast extract) at 32° C. for a total of 18 hours at 150 rpm at 32° C. Cells were harvested at ~18 hours, the cultures were centrifuged at 3500 rpm for 5 minutes, and the supernatant was discarded. Cells were suspended in ~10 mL tap water, and total yeast concentration was determined using a YC-100 Nucleocounter. Industrially obtained liquefied corn mash, where liquefaction was carried out using Liquozyme Pro, was supplemented with 3 ppm lactrol and 500 ppm of urea. Simultaneous saccharification and fermentation (SSF) was performed via mini-scale fermentations. Approximately 5 g of liquefied corn mash was added to 15 mL conical tubes. Tubes were dosed with either 0.42 AGU/g of dry solids of an exogenous glucoamylase blend Glucoamylase BL2 or no exogenous glucoamylase blend followed by the addition of yeast expressing beta-glucanase. 10^6 yeast cells/g of corn mash were pitched. As control, MeJi797 (yeast without expression of beta-glucanase) was pitched at 10^6 cells/g of corn mash. Glucoamylase and yeast dosages were administered based on the exact weight of corn slurry in each tube. Tubes were incubated at 32° C. Triplicates of each strain were analyzed after 65 hour fermentations. Fermentations were stopped by addition of 50 uL of 40% $H_2SO_4$, followed by centrifuging, and filtration through a 0.2 micron filter. Ethanol, oligosaccharides, glucose, and organic acids concentrations were determined using HPLC. Reaction conditions are summarized in Table 67.

TABLE 67

| Mini-tube fermentation reaction conditions | |
|---|---|
| Substrate | Liquozyme Pro corn mash |
| Yeast pitch | 10^6 cells/g corn mash |
| Exogenous glucoamylase product dose | 0.42 AGU/g-DS or no addition (0 AGU/g-DS) |
| pH | 5.2 |
| Incubation temperature | 32° C. |
| Reaction time | 65 hours |

Fermentation Results

Figure 2:
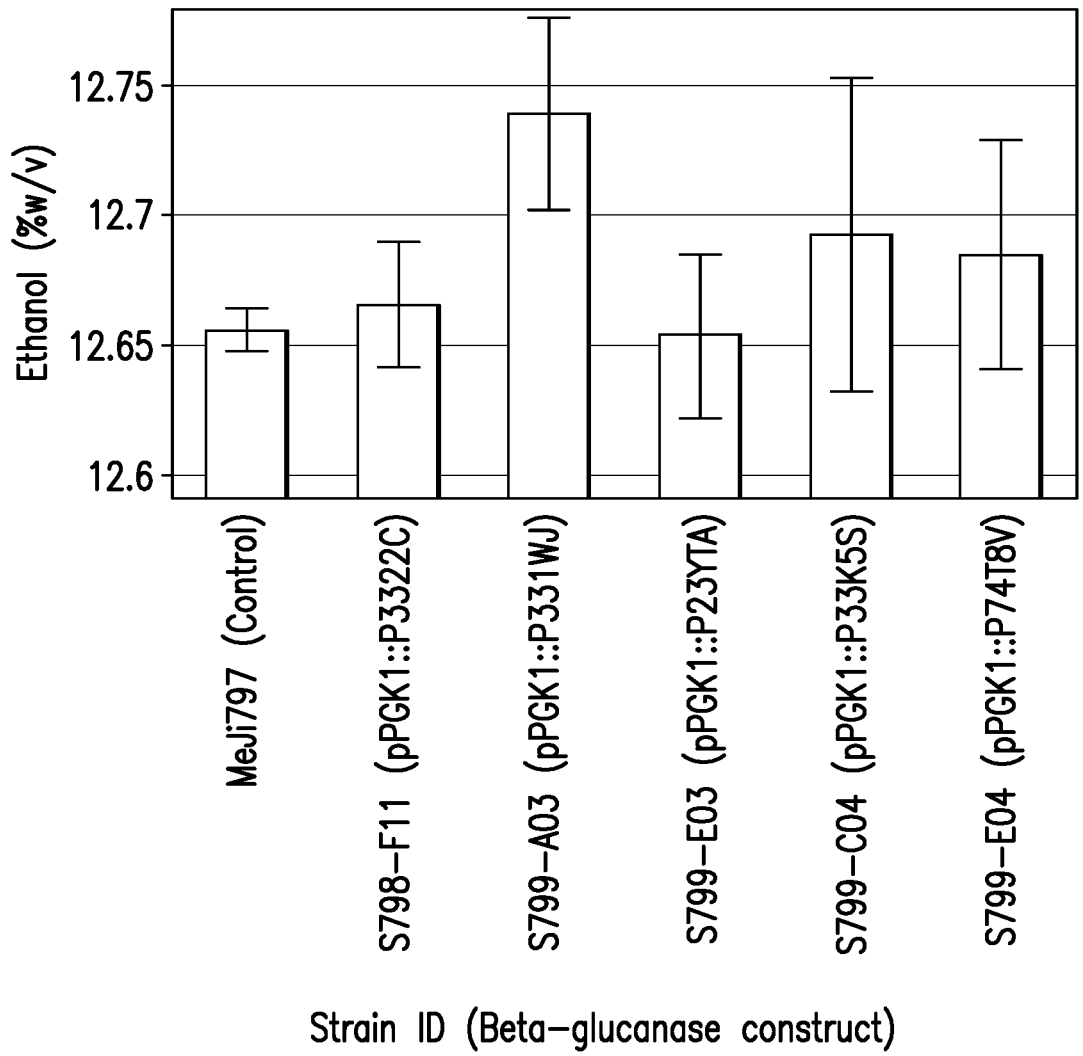
FIG. 2: Ethanol fermentation results for strains expressing beta-glucanase in background MeJi797 treated with 0.42 AGU/g-DS of exogenous glucoamylase.
Figure 3:
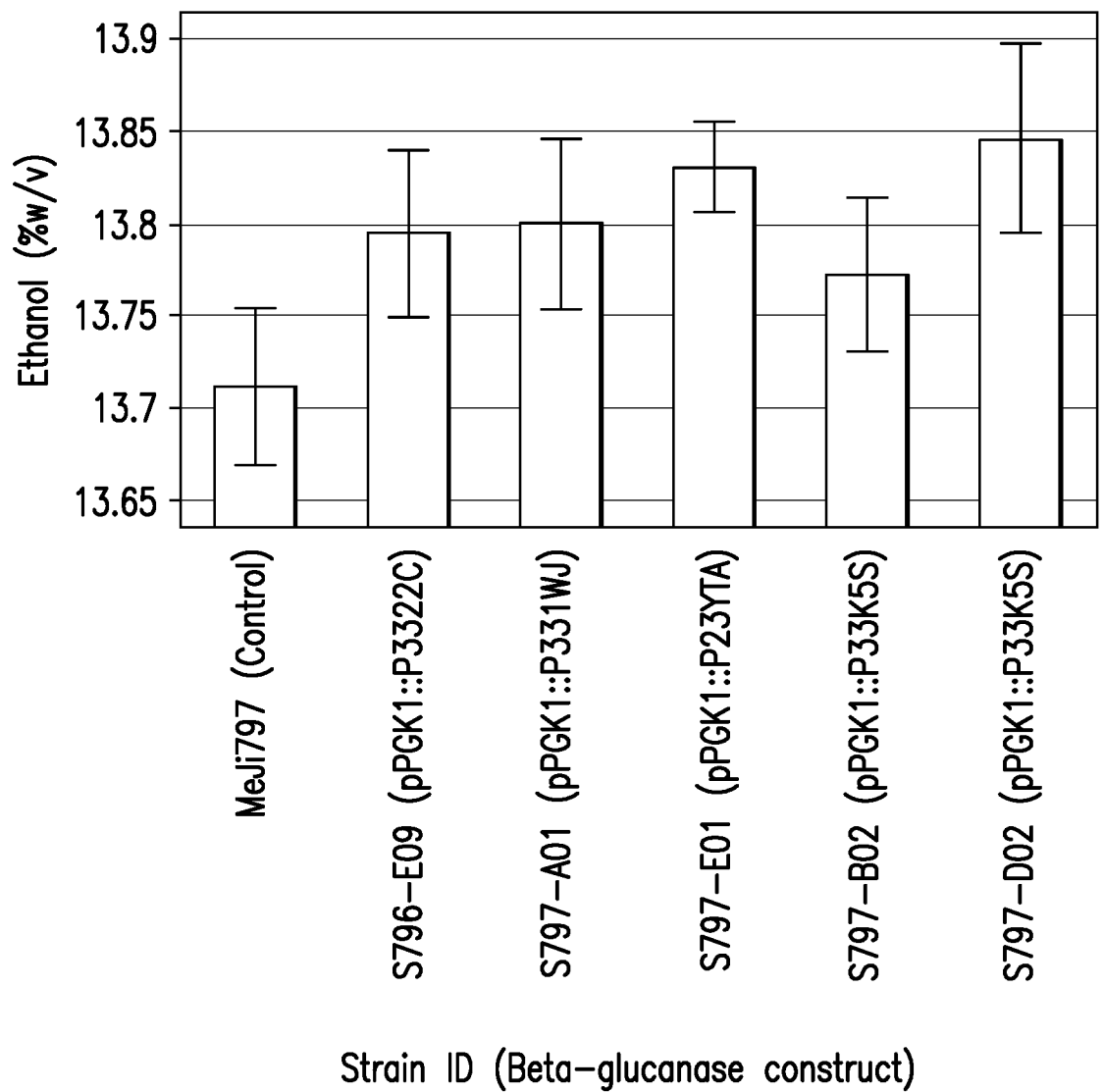
FIG. 3: Ethanol fermentation results for strains expressing beta-glucanase in background MeJi797 treated without exogenous glucoamylase addition.

FIG. 2 and FIG. 3 show the results of strains expressing beta-glucanase in background strain MeJi797 treated with 0.42 AGU/g-DS of exogenous glucoamylase and no exogenous glucoamylase, respectively. Strain S799-A03, which expresses the GH131 beta-glucanase of SEQ ID NO: 59 shows an increase in ethanol compared to the control in the 0.42 AGU/g-DS treatment and the 0 AGU/g-DS treatment of 0.1% w/v and 0.75% w/v, respectively.

Figure 4:
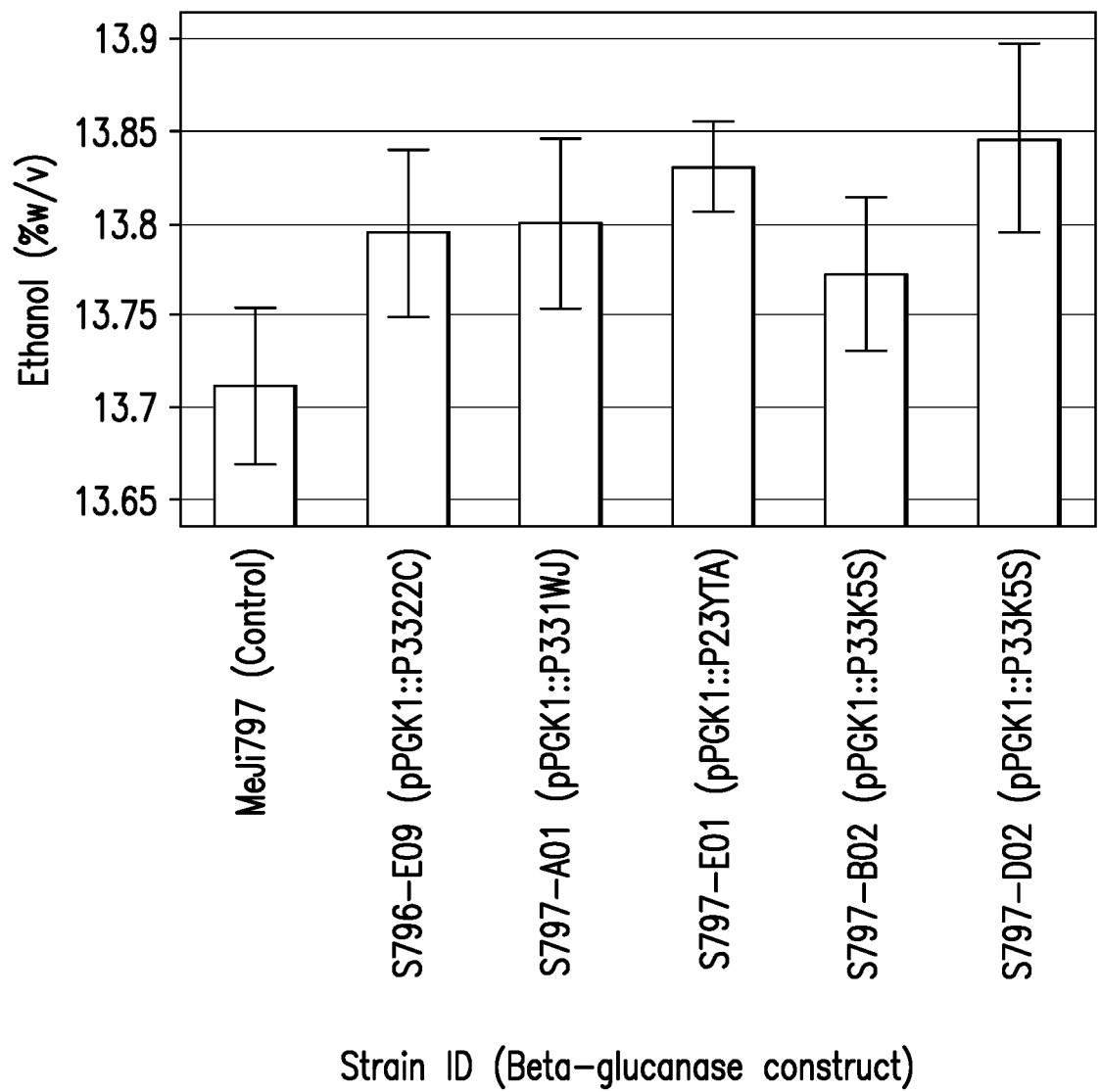
FIG. 4: Ethanol fermentation results for strains expressing beta-glucanase in background strain S709-A06 treated with 0.42 AGU/g-DS of exogenous glucoamylase.
Figure 5:
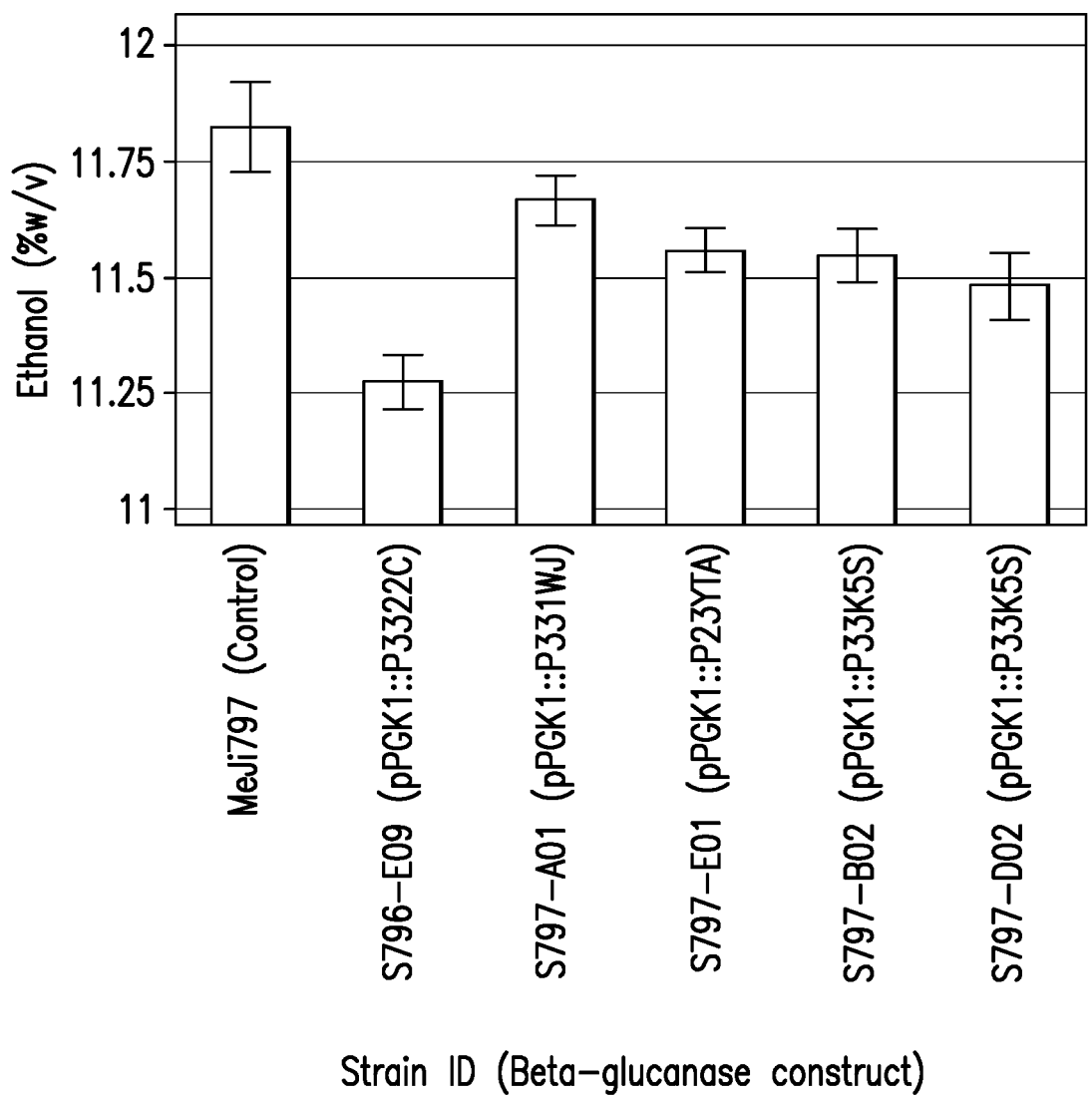
FIG. 5: Ethanol fermentation results for strains expressing beta-glucanase in background strain S709-A06 treated without exogenous glucoamylase addition.

FIG. 4 and FIG. 5 show the results of strains expressing beta-glucanase in background strain S709-A06 where tubes were treated with 0.42 AGU/g-DS of exogenous glucoamylase and no exogenous glucoamylase, respectively. Strain S797-D02, which expresses the GH131 beta-glucanase of SEQ ID NO: 50 shows an increase in ethanol compared to the control of 0.13% w/v in the 0.42 AGU/g-DS treatment Strain S797-E01, which expresses the GH131 beta-glucanase of SEQ ID NO: 62 shows an increase in ethanol compared to the control of 0.12% w/v in the 0.42 AGU/g-DS treatment. All strains with beta-glucanase expressed in background S709-A06 produced less ethanol than the control, MeJi797, when no exogenous glucoamylase was added.

Example 43: Construction of Yeast Strains Co-Expressing Two Beta-Glucanases

This example describes the construction of yeast cells containing two beta-glucanase genes under the control of three S. cerevisiae promoters: pRPL18B, pPMA1 and pPGK1. Five pieces of DNA containing promoters, genes and terminators were designed to allow for homologous recombination between the five DNA fragments and into the X-3 locus of the yeasts MeJi797 and S709-A06 (MeJi797 with A. fumigatus beta-glucosidase described herein). The resulting strains have one 5' homology containing fragment with a promoter, two promoter and gene containing fragments, one terminator and promoter containing fragment, and one 3' homology fragment with a terminator (right fragment) integrated into the S. cerevisiae genome at the X-3 locus.

Construction of the 5' X-3 Homology Containing Fragment with pRPL18B (Left Fragment 1)

The linear DNA containing 500 bp homology to the X-3 site and the S. cerevisiae pRPL18B promoter was PCR amplified from HP5 plasmid DNA using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100™ Thermal Cycler (Bio-Rad Laboratories, Inc.)

programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pRPL18B Promoter and *Trichoderma harzianum* GH5_15 Coding Sequence (Middle Fragment 1)

The linear DNA containing 51 bp homology to the *S. cerevisiae* pRPL18B promoter was PCR amplified from S686-A04 genomic DNA using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100m Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction Fragment with pRPL18B Promoter and *Simplicillium lamellicola* GH5_15 Coding Sequence (Middle Fragment 2)

The linear DNA containing 51 bp homology to the *S. cerevisiae* pRPL18B promoter was PCR amplified from S687-C10 genomic DNA using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100m Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pRPL18B Promoter and *Trichoderma atroviride* GH5_15 Coding Sequence (Middle Fragment 3)

The linear DNA containing 51 bp homology to the *S. cerevisiae* pRPL18B promoter was PCR amplified from S686-F03 genomic DNA using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100m Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of the pPGK1 Containing Fragment with tTEF1 (Middle Fragment 4)

The linear DNA containing 143 bp homology to the *S. cerevisiae* tTEF1 terminator and the pPGK1 promoter was PCR amplified using fifty pmoles each of forward and reverse primer was used in a PCR reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100m Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pPGK1 Promoter and *Rhinocladiella* sp. GH131 Coding Sequence (Middle Fragment 5)

The linear DNA containing 50 bp homology to the *S. cerevisiae* pPGK1 promoter was PCR amplified from synthetic Twist DNA (comprising the *Rhinocladiella* sp. GH131 coding sequence for SEQ ID NO: 56) using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pPGK1 Promoter and *Nemania serpens* GH131 Coding Sequence (Middle Fragment 6)

The linear DNA containing 50 bp homology to the *S. cerevisiae* pPGK1 promoter was PCR amplified from synthetic Twist DNA (comprising the *Nemania serpens* GH131 coding sequence for SEQ ID NO: 59) using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pPGK1 Promoter and *Talaromyces leycettanus* GH131 Coding Sequence (Middle Fragment 7)

The linear DNA containing 50 bp homology to the *S. cerevisiae* pPGK1 promoter was PCR amplified from synthetic Twist DNA (comprising the *Talaromyces leycettanus* GH131 coding sequence for SEQ ID NO: 62) using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pPGK1 Promoter and *Acrophialophora fusispora* GH131 Coding Sequence (Middle Fragment 8)

The linear DNA containing 50 bp homology to the *S. cerevisiae* pPGK1 promoter was PCR amplified from synthetic Twist DNA (comprising the *Acrophialophora fusispora* GH131 coding sequence for SEQ ID NO: 50) using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pPGK1 Promoter and *Rigidoporus* sp. GH131 Coding Sequence (Middle Fragment 9)

The linear DNA containing 50 bp homology to the *S. cerevisiae* pPGK1 promoter was PCR amplified from synthetic Twist DNA (comprising the *Rigidoporus* sp. GH131 coding sequence for SEQ ID NO: 68) using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pPGK1 Promoter and *Trichoderma harzianum* GH64 Coding Sequence (Middle Fragment 10)

The linear DNA containing 50 bp homology to the *S. cerevisiae* pPGK1 promoter was PCR amplified using fifty pmoles each of forward and reverse primer in a reaction containing 5 ng of plasmid DNA template (comprising the *Trichoderma harzianum* GH64 coding sequence for SEQ ID NO: 11), 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pPGK1 Promoter and *Simplicillium lamellicola* GH64 Coding Sequence (Middle Fragment 11)

The linear DNA containing 50 bp homology to the *S. cerevisiae* pPGK1 promoter was PCR amplified using fifty pmoles each of forward and reverse primer in a reaction containing 5 ng of plasmid DNA as template (comprising the *Simplicillium lamellicola* GH64 coding sequence for SEQ ID NO: 17), 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of the pPMA1 Containing Fragment with tTEF1 (Middle Fragment 12)

The linear DNA containing 143 bp homology to the *S. cerevisiae* tTEF1 terminator and the pPMA1 promoter was PCR amplified from TP35 genomic DNA using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pPMA1 Promoter and *Trichoderma harzianum* GH55_3 Coding Sequence (Middle Fragment 13)

The linear DNA containing 52 bp homology to the *S. cerevisiae* pPMA1 promoter was PCR amplified from S715-C08 genomic DNA using fifty pmoles each of forward and reverse primer was used in a PCR reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of the 3' X-3 Homology Containing Fragment with tPRM9 (Right Fragment 1)

The linear DNA containing 500 bp homology to the X-3 site and the *S. cerevisiae* tPRM9 terminator was PCR amplified from TH37 plasmid DNA using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of the 3' X-3 Homology Containing Fragment with tPDC6 (Right Fragment 2)

The linear DNA containing 500 bp homology to the X-3 site and the *S. cerevisiae* tPDC6 terminator was PCR amplified from TH39 plasmid DNA using pmoles each of forward and reverse primer was used in a PCR reaction containing 5 ng of plasmid DNA as template, 1× Platinum SuperFi HF Buffer (Thermo Fisher Scientific), and 2 units SuperFi DNA polymerase in a final volume of 50 μL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Integration of Left, Middle, and Right-Hand Fragments to Generate Yeast Strains Expressing GH5_15 and GH131 Beta-Glucanases The yeasts MeJi797 or S709-A06 were transformed with the left, middle and right integration fragments described above. In each transformation pool, the left fragment and right fragment with 50 ng of each fragment was used. There was one set of the left, middle, and one right fragment pools used: left fragment 1, middle fragment 4, and right fragment 1 (Blend 1 master mix). There was also two additional middle fragments consisting of a signal peptide and beta-glucanase gene with ~50 ng of each fragment (200 ng total). One of the middle fragments 1-3 and one of middle fragments 5-9 was transformed in each construct. To aid homologous recombination of the left, middle and right fragments at the genomic X-3 sites a plasmid containing MAD7 and guide RNA specific to X-3 (pMIBa647) was also used in the transformation. These two middle components were combined with the Blend mastermix and transformed into the into S. cerevisiae strains MeJi797 or 709-A06 following a yeast electroporation protocol. Transformants were selected on YPD+cloNAT to select for transformants that contain the Mad7 plasmid pMIBa647. Transformants were either picked manually by hand onto YPD plates or by using a Q-pix Colony Picking System (Molecular Devices) to inoculate well of 96-well plate containing YPD media. The plates were grown for 2 days then glycerol was added to 20% final concentration and the plates were stored at −80° C. until needed. Integration of specific beta-glucanase construct was verified by PCR with locus specific primers and subsequent sequencing. The strains generated by transformation in MeJi797 and S709-A06 of this example are shown in Tables 68 and 69, respectively.

TABLE 68

Strains with GH5_15 and GH131 beta-glucanase genes transformed into MeJi797

| Strain ID | Promoter 1 | Beta-glucanase 1 | Promoter 2 | Beta-glucanase 2 |
|---|---|---|---|---|
| MeJi797 | — | — | — | — |
| S797-D09 | pRPL18B | SEQ ID NO: 2 | pPGK1 | SEQ ID NO: 56 |
| S797-A10 | pRPL18B | SEQ ID NO: 2 | pPGK1 | SEQ ID NO: 62 |
| S797-D10 | pRPL18B | SEQ ID NO: 2 | pPGK1 | SEQ ID NO: 62 |
| S797-E10 | pRPL18B | SEQ ID NO: 2 | pPGK1 | SEQ ID NO: 50 |
| S798-F06 | pRPL18B | SEQ ID NO: 35 | pPGK1 | SEQ ID NO: 68 |
| S798-A07 | pRPL18B | SEQ ID NO: 41 | pPGK1 | SEQ ID NO: 56 |
| S798-D07 | pRPL18B | SEQ ID NO: 41 | pPGK1 | SEQ ID NO: 56 |
| S798-F07 | pRPL18B | SEQ ID NO: 41 | pPGK1 | SEQ ID NO: 59 |
| S798-G07 | pRPL18B | SEQ ID NO: 41 | pPGK1 | SEQ ID NO: 59 |
| S798-H07 | pRPL18B | SEQ ID NO: 41 | pPGK1 | SEQ ID NO: 59 |
| S798-A10 | pRPL18B | SEQ ID NO: 41 | pPGK1 | SEQ ID NO: 62 |
| S798-B10 | pRPL18B | SEQ ID NO: 41 | pPGK1 | SEQ ID NO: 62 |
| S798-D10 | pRPL18B | SEQ ID NO: 41 | pPGK1 | SEQ ID NO: 62 |
| S798-F10 | pRPL18B | SEQ ID NO: 41 | pPGK1 | SEQ ID NO: 50 |
| S798-G10 | pRPL18B | SEQ ID NO: 41 | pPGK1 | SEQ ID NO: 50 |
| S798-H10 | pRPL18B | SEQ ID NO: 41 | pPGK1 | SEQ ID NO: 50 |
| S798-B11 | pRPL18B | SEQ ID NO: 41 | pPGK1 | SEQ ID NO: 68 |

TABLE 69

Strains with GH5_15 and GH131 beta-glucanase genes transformed into S709-A06

| Strain ID | Promoter 1 | Beta-glucanase gene 1 | Promoter 2 | Beta-glucanase gene 2 |
|---|---|---|---|---|
| S709-A06 | — | — | — | — |
| S795-B07 | pRPL18B | SEQ ID NO: 2 | pPGK1 | SEQ ID NO: 56 |
| S795-C07 | pRPL18B | SEQ ID NO: 2 | pPGK1 | SEQ ID NO: 56 |
| S795-E07 | pRPL18B | SEQ ID NO: 2 | pPGK1 | SEQ ID NO: 59 |
| S795-G07 | pRPL18B | SEQ ID NO: 2 | pPGK1 | SEQ ID NO: 59 |
| S795-B08 | pRPL18B | SEQ ID NO: 2 | pPGK1 | SEQ ID NO: 62 |
| S795-H11 | pRPL18B | SEQ ID NO: 35 | pPGK1 | SEQ ID NO: 56 |
| S796-H01 | pRPL18B | SEQ ID NO: 35 | pPGK1 | SEQ ID NO: 62 |
| S796-B04 | pRPL18B | SEQ ID NO: 35 | pGK1 | SEQ ID NO: 50 |
| S796-A05 | pRPL18B | SEQ ID NO: 41 | pPGK1 | SEQ ID NO: 56 |

TABLE 69-continued

Strains with GH5_15 and GH131 beta-glucanase genes transformed into S709-A06

| Strain ID | Promoter 1 | Beta-glucanase gene 1 | Promoter 2 | Beta-glucanase gene 2 |
|---|---|---|---|---|
| S796-D05 | pRPL18B | SEQ ID NO: 41 | pPGK1 | SEQ ID NO: 56 |
| S796-E05 | pRPL18B | SEQ ID NO: 41 | pPGK1 | SEQ ID NO: 59 |
| S796-F05 | pRPL18B | SEQ ID NO: 41 | pPGK1 | SEQ ID NO: 59 |
| S796-G06 | pRPL18B | SEQ ID NO: 41 | pPGK1 | SEQ ID NO: 59 |
| S796-B08 | pRPL18B | SEQ ID NO: 41 | pPGK1 | SEQ ID NO: 62 |
| S796-D08 | pRPL18B | SEQ ID NO: 41 | pPGK1 | SEQ ID NO: 62 |
| S796-E08 | pRPL18B | SEQ ID NO: 41 | pPGK1 | SEQ ID NO: 50 |
| S796-F08 | pRPL18B | SEQ ID NO: 41 | pPGK1 | SEQ ID NO: 50 |
| S796-G08 | pRPL18B | SEQ ID NO: 41 | pPGK1 | SEQ ID NO: 50 |
| S796-H08 | pRPL18B | SEQ ID NO: 41 | pPGK1 | SEQ ID NO: 50 |
| S796-A09 | pRPL18B | SEQ ID NO: 41 | pPGK1 | SEQ ID NO: 68 |
| S796-B09 | pRPL18B | SEQ ID NO: 41 | pPGK1 | SEQ ID NO: 68 |
| S796-C09 | pRPL18B | SEQ ID NO: 41 | pPGK1 | SEQ ID NO: 68 |
| S796-D09 | pRPL18B | SEQ ID NO: 41 | pPGK1 | SEQ ID NO: 68 |

Integration of Left, Middle, and Right-Hand Fragments to Generate Yeast Strains Expressing GH5_15 and GH64 Beta-Glucanases The yeasts MeJi797 or S709-A06 were transformed with the left, middle and right integration fragments described above. In each transformation pool, the left fragment and right fragment with 50 ng of each fragment was used. There was one set of the left, middle, and one right fragment pools used: left fragment 1, middle fragment 4, and right fragment 1 (Blend 1 master mix). There was also two additional middle fragments consisting of a signal peptide and beta-glucanase gene with ~50 ng of each fragment (200 ng total). One of the middle fragments 1-3 and one of middle fragments 10-11 was transformed in each construct. To aid homologous recombination of the left, middle and right fragments at the genomic X-3 sites a plasmid containing MAD7 and guide RNA specific to X-3 (pMIBa647) was also used in the transformation. These two middle components were combined with the Blend 1 master mix and transformed into the into S. cerevisiae strains MeJi797 or S709-A06 following a yeast electroporation protocol. Transformants were selected on YPD+cloNAT to select for transformants that contain the Mad7 plasmid pMIBa647. Transformants were either picked manually by hand onto YPD plates or by using a Q-pix Colony Picking System (Molecular Devices) to inoculate 1 well of 96-well plate containing YPD media. The plates were grown for 2 days then glycerol was added to 20% final concentration and the plates were stored at −80° C. until needed. Integration of specific beta-glucanase construct was verified by PCR with locus specific primers and subsequent sequencing. The strains generated by transformation in MeJi797 and S709-A06 are shown in Tables 70 and 71, respectively.

TABLE 70

Strains with GH5_15 and GH64 beta-glucanase genes transformed in MeJi797

| Strain ID | Promoter1 | Beta-glucanase 1 | Promoter 2 | Beta-glucanase 2 |
|---|---|---|---|---|
| MeJi797 | — | — | — | — |
| S797-A04 | pRPL18B | SEQ ID NO: 41 | pPGK1 | SEQ ID NO: 11 |
| S797-C04 | pRPL18B | SEQ ID NO: 41 | pPGK1 | SEQ ID NO: 11 |
| S797-E07 | pRPL18B | SEQ ID NO: 41 | pPGK1 | SEQ ID NO: 17 |
| S797-F07 | pRPL18B | SEQ ID NO: 41 | pPGK1 | SEQ ID NO: 17 |
| S797-G07 | pRPL18B | SEQ ID NO: 41 | pPGK1 | SEQ ID NO: 17 |
| S797-H07 | pRPL18B | SEQ ID NO: 41 | pPGK1 | SEQ ID NO: 17 |

TABLE 71

Strains with GH5_15 and GH64 beta-glucanase genes transformed in S709-A06

| Strain ID | Promoter1 | Beta-glucanase 1 | Promoter 2 | Beta-glucanase 2 |
|---|---|---|---|---|
| S709-A06 | — | — | — | — |
| S795-B05 | pRPL18B | SEQ ID NO: 35 | pPGK1 | SEQ ID NO: 17 |

Integration of Left, Middle, and Right-Hand Fragments to Generate Yeast Strains Expressing GH5_15 and GH55_3 Beta-Glucanases The yeast MeJi797 was transformed with the left, middle and right integration fragments described above. In each transformation pool, the left fragment and right fragment with 50 ng of each fragment was used. There was one set of the left, middle, and one right fragment pools used: left fragment 1, middle fragment 12, and right fragment 2 (Blend 2 master mix). There was also two additional middle fragments consisting of a signal peptide and beta-glucanase gene with ~50 ng of each fragment (200 ng total). One of the middle fragments 1-3 and middle fragment 13 was transformed in each construct. To aid homologous recombination of the left, middle and right fragments at the genomic X-3 sites a plasmid containing MAD7 and guide RNA specific to X-3 (pMIBa647) was also used in the transformation. These two middle components were combined with the Blend 2 master mix and transformed into the into S. cerevisiae strain MeJi797 following a yeast electroporation protocol. Transformants were selected on YPD+cloNAT to select for transformants that contain the Mad7 plasmid pMIBa647. Transformants were either picked manually by hand onto YPD plates or by using a Q-pix Colony Picking System (Molecular Devices) to inoculate one well of 96-well plate containing YPD media. The plates were grown for 2 days then glycerol was added to 20% final concentration and the plates were stored at −80° C. until needed. Integration of specific beta-glucanase construct was verified by PCR with locus specific primers and subsequent sequencing. The strains generated by transformation in MeJi797 are shown in Table 72.

TABLE 72

Strains with GH5_15 and GH55_3 beta-glucanase genes transformed in MeJi797

| Strain ID | Promoter1 | Beta-glucanase 1 | Promoter 2 | Beta-glucanase 2 |
|---|---|---|---|---|
| MeJi797 | — | — | — | — |
| S797-A08 | pRPL18B | SEQ ID NO: 2 | pPMA1 | SEQ ID NO: 108 |
| S797-E08 | pRPL18B | SEQ ID NO: 35 | pPMA1 | SEQ ID NO: 108 |
| S797-A11 | pRPL18B | SEQ ID NO: 41 | pPMA1 | SEQ ID NO: 108 |
| S797-C11 | pRPL18B | SEQ ID NO: 41 | pPMA1 | SEQ ID NO: 108 |
| S797-D11 | pRPL18B | SEQ ID NO: 41 | pPMA1 | SEQ ID NO: 108 |

Example 44: Fermentation Performance of Yeast Strains Co-Expressing Two Beta-Glucanases This example describes the evaluation of yeast strains expressing two beta-glucanases on final ethanol titer in a corn mash fermentation.

Preparation of Yeast Culture for Tube Fermentations

Yeast strains were incubated overnight in YPD media (6% w/v D-glucose, 2% peptone, 1% yeast extract) with 6% total glucose at 32° C. for a total of 18 hours at 150 rpm at 32° C. Cells were harvested at ~18 hours, the cultures were centrifuged at 3500 rpm for 5 minutes, and the supernatant was discarded. Cells were suspended in ~10 mL tap water, and total yeast concentration was determined using a YC-100 Nucleocounter. Industrially obtained liquefied corn mash, where liquefaction was carried out using Liquozyme Pro, was supplemented with 3 ppm lactrol and 500 ppm of urea. Simultaneous saccharification and fermentation (SSF) was performed via mini-scale fermentations. Approximately 5 g of liquefied corn mash was added to 15 mL conical tubes. Tubes were dosed with either 0.42 AGU/g of dry solids of an exogenous glucoamylase blend Glucoamylase BL2 or no exogenous glucoamylase blend followed by the addition of yeast expressing two beta-glucanases. 10^6 yeast cells/g of corn mash were pitched. As control, MeJi797 (yeast without expression of beta-glucanase) was pitched at 10^6 cells/g of corn mash. Glucoamylase and yeast dosages were administered based on the exact weight of corn slurry in each tube. Tubes were incubated at 32° C. Triplicates of each strain were analyzed after 65 hour fermentations. Fermentations were stopped by addition of 50 uL of 40% $H_2SO_4$ followed by centrifuging and filtration through a 0.2 micron filter. Ethanol, oligosaccharides, glucose, and organic acids concentrations were determined using HPLC. Reaction conditions are summarized in Table 73.

TABLE 73

Mini-tube fermentation reaction conditions

| | |
|---|---|
| Substrate | Liquozyme Pro corn mash |
| Yeast pitch | 10^6 cells/g corn mash |
| Exogenous glucoamylase product dose | 0.42 AGU/g-DS or no addition (0 AGU/g-DS) |
| pH | 5.2 |
| Incubation temperature | 32° C. |
| Reaction time | 65 hours |

Fermentation Results

Figure 6:
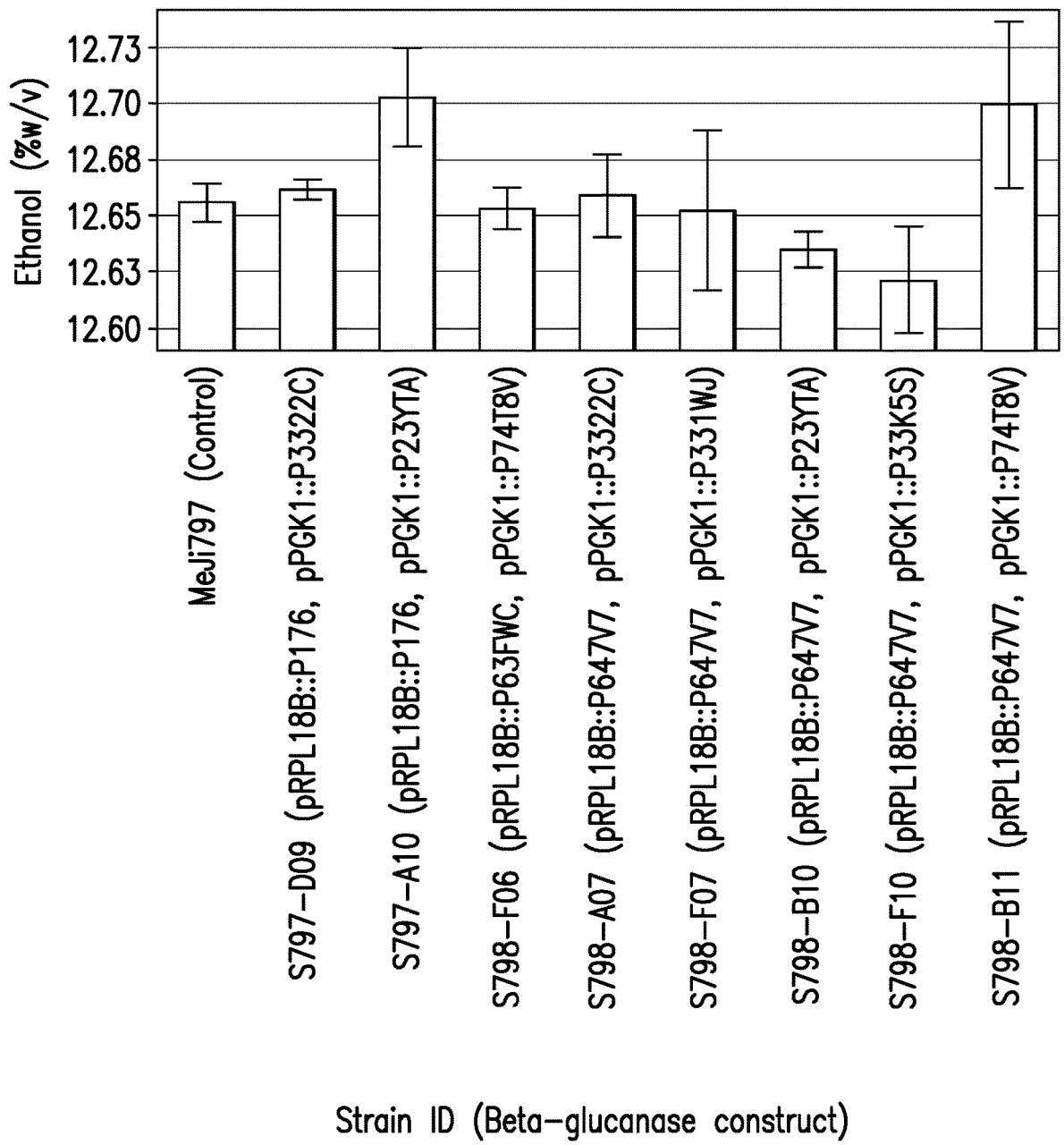
FIG. 6: Ethanol fermentation results for strains expressing GH5_15 and GH131 beta-glucanases in background strain MeJi797 treated with 0.42 AGU/g-DS of exogenous glucoamylase.
Figure 7:
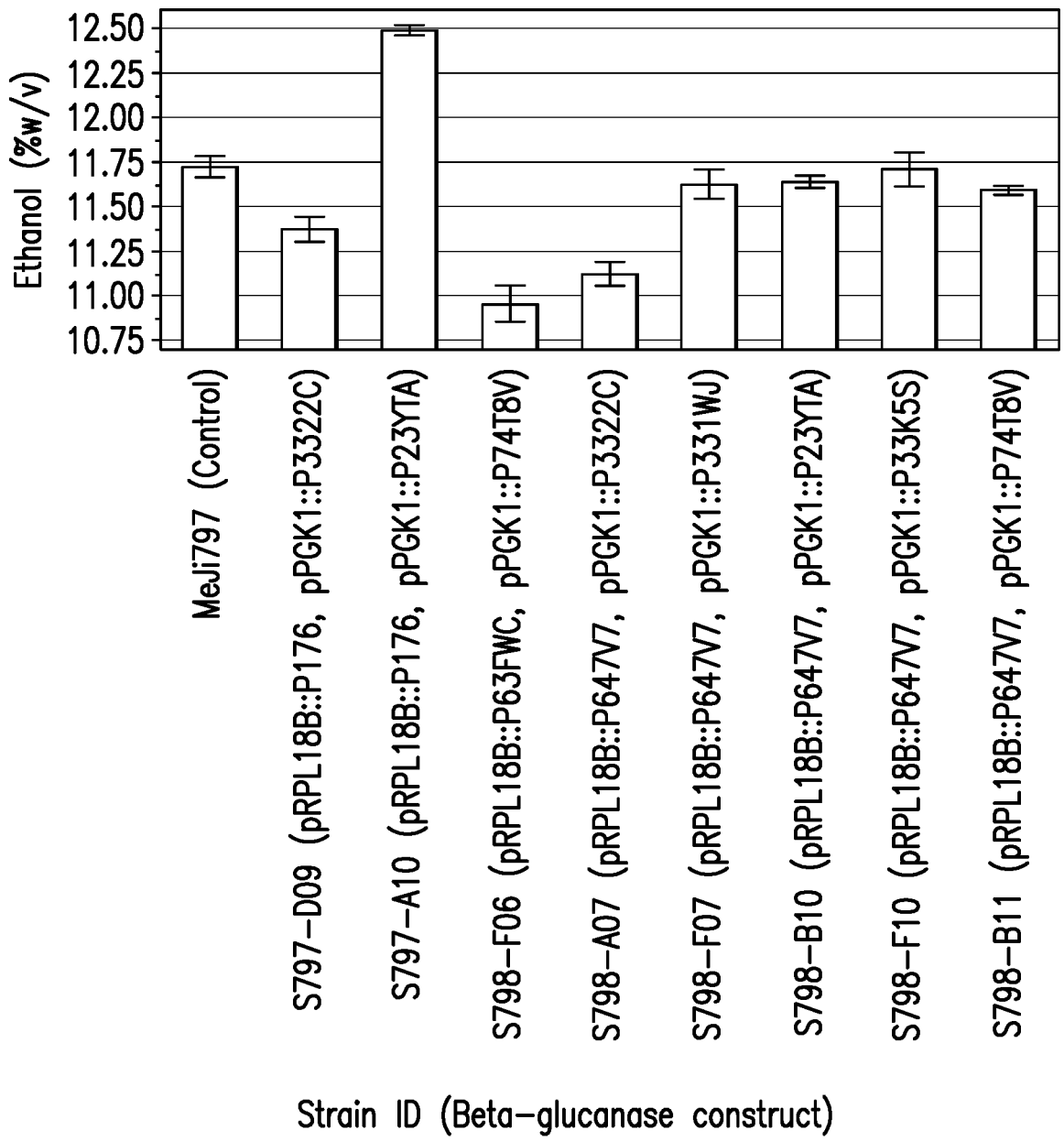
FIG. 7: Ethanol fermentation results for strains expressing GH5_15 and GH131 beta-glucanases in background strain MeJi797 treated without exogenous glucoamylase addition.

FIG. 6 and FIG. 7 show the results of strains expressing a GH5_15 and GH131 in background strain MeJi797 where tubes were treated with 0.42 AGU/g-DS of exogenous glucoamylase and no exogenous glucoamylase, respectively. Strain S797-A10, which co-expresses the beta-glucanase enzymes of SEQ ID NO: 2 and SEQ ID NO: 62 in MeJi797, shows an increase in ethanol of 0.77% compared to control in the 0 AGU/g-DS glucoamylase treatment.

Figure 8:
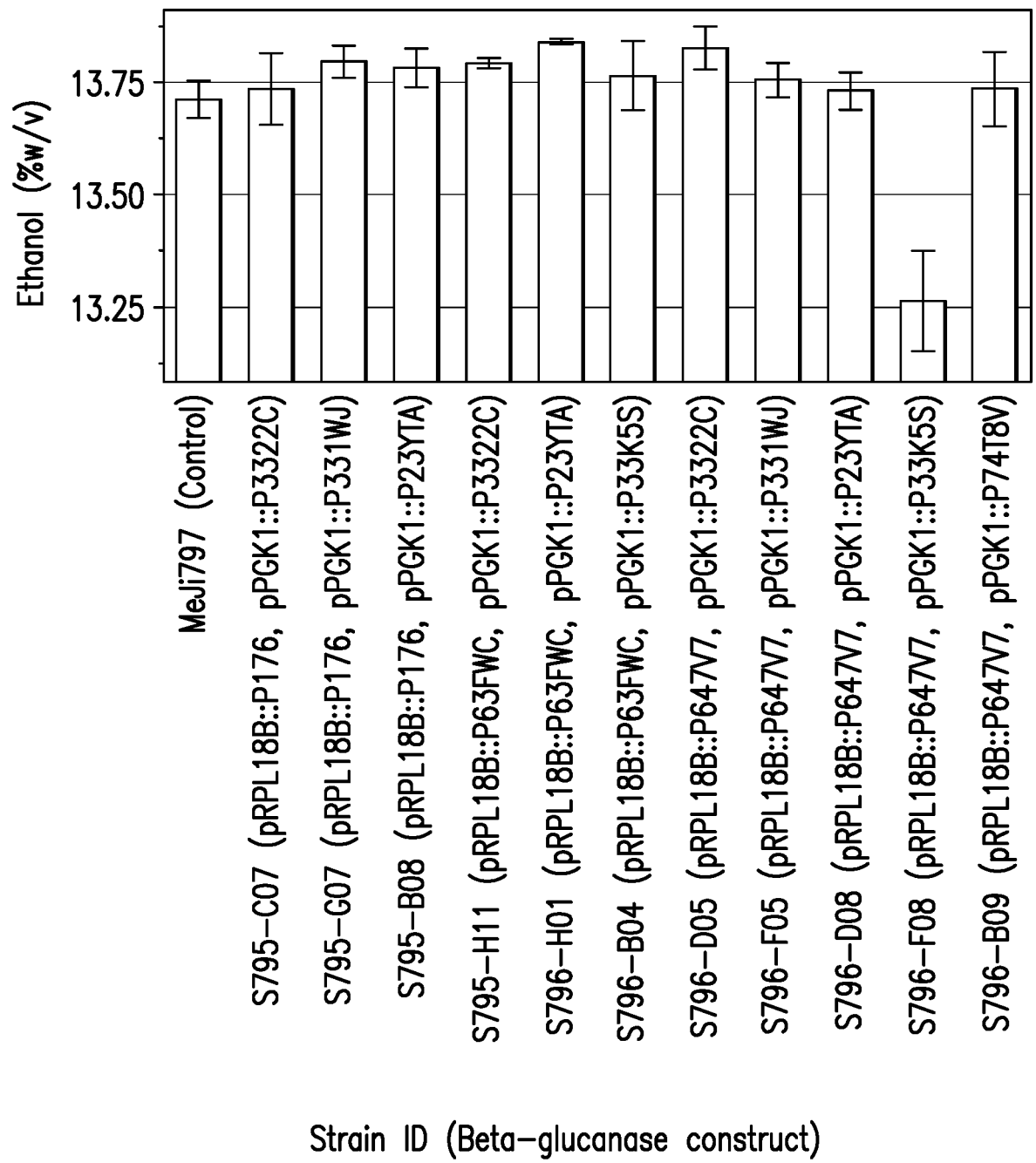
FIG. 8: Ethanol fermentation results for strains expressing GH5_15 and GH131 beta-glucanases in background strain S709-A06 treated with 0.42 AGU/g-DS of exogenous glucoamylase.
Figure 9:
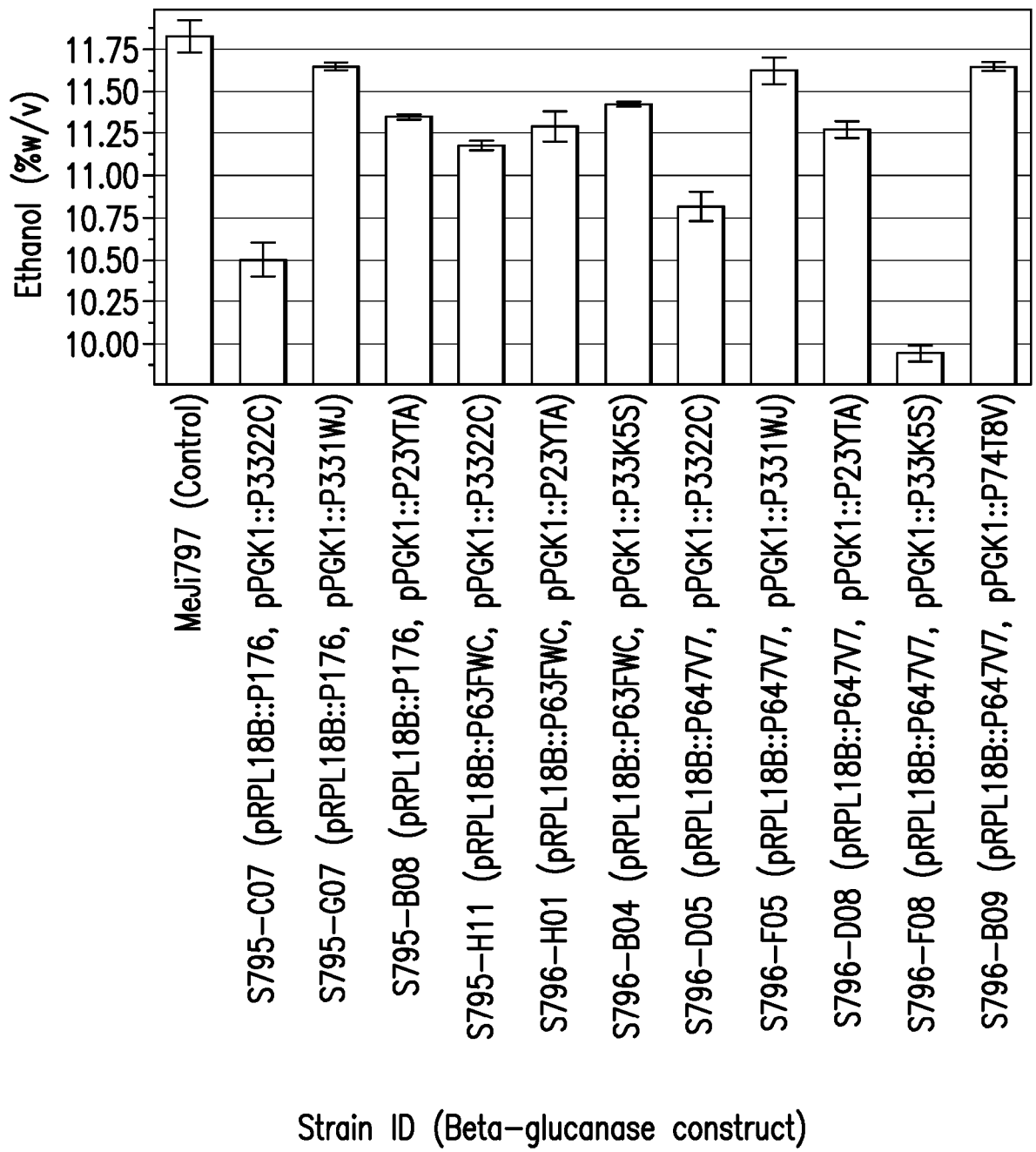
FIG. 9: Ethanol fermentation results for strains expressing GH5_15 and GH131 beta-glucanases in background strain S709-A06 treated without exogenous glucoamylase addition.

FIG. 8 and FIG. 9 show the results of strains expressing a GH5_15 and GH131 in background strain S709-A06 where tubes were treated with 0.42 AGU/g-DS of exogenous glucoamylase and no exogenous glucoamylase, respectively. Strain S796-H01, which co-expresses the beta-glucanase enzymes of SEQ ID NO: 35 and SEQ ID NO: 62 in S709-A06, shows an increase in ethanol of 0.13% w/v compared to the control in the 0.42 AGU/g-DS glucoamylase treatment.

Figure 10:
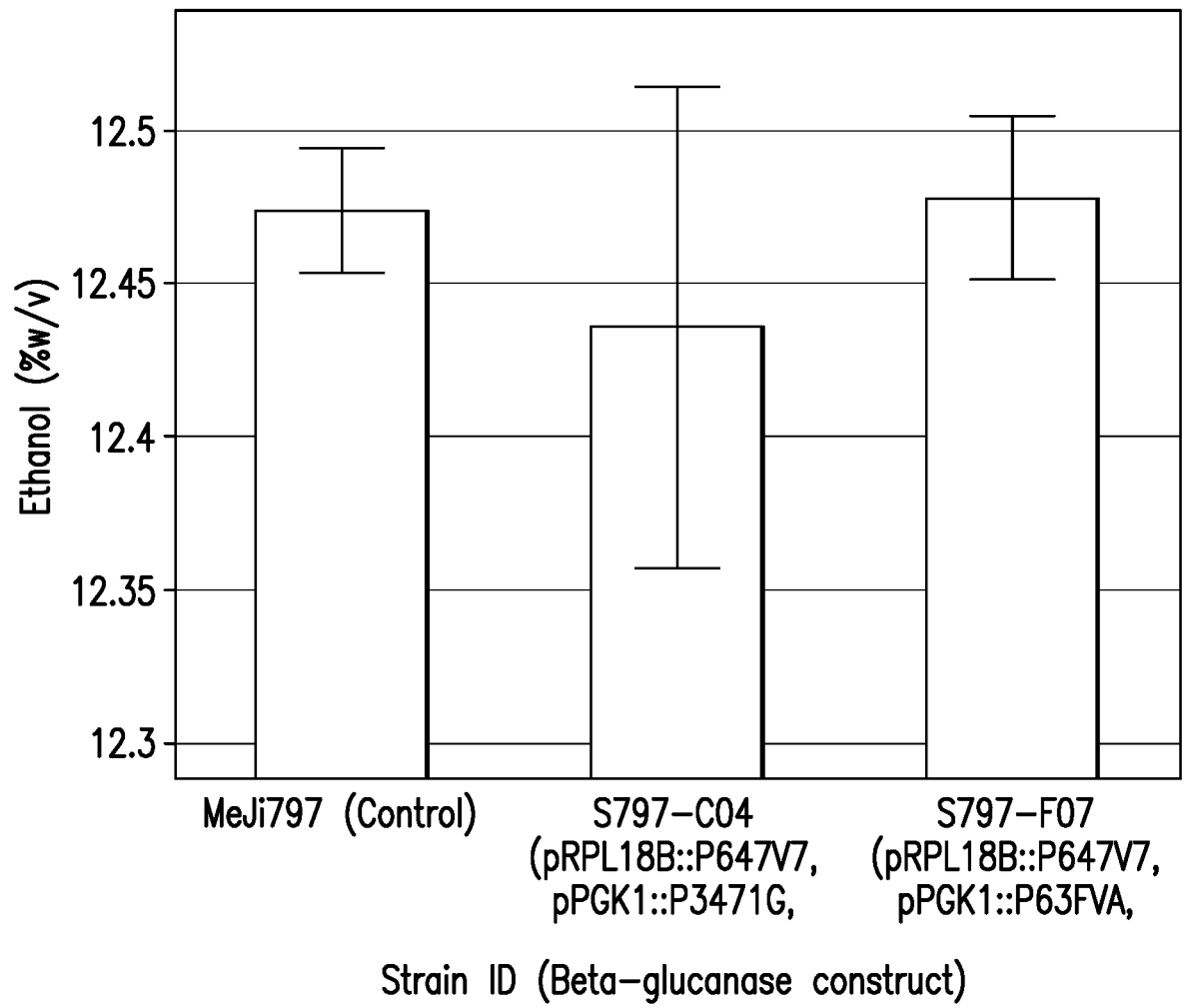
FIG. 10: Ethanol fermentation results for strains expressing GH5_15 and GH64 beta-glucanases in background strain MeJi797 treated with 0.42 AGU/g-DS of exogenous glucoamylase.
Figure 11:
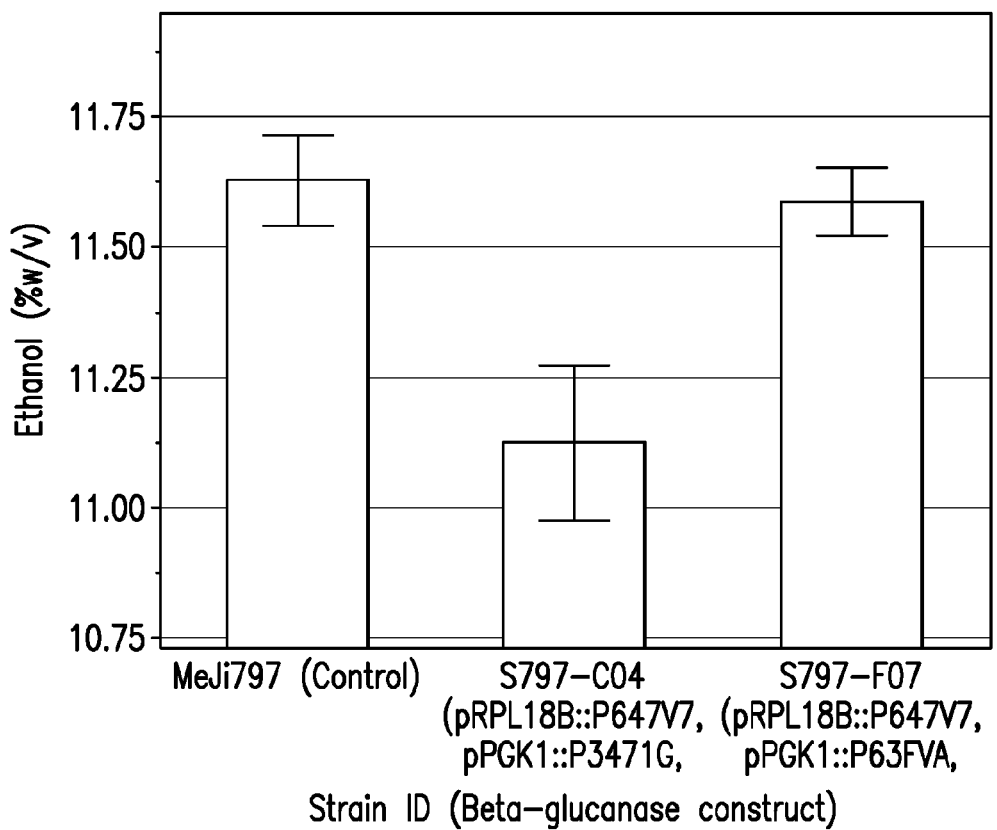
FIG. 11: Ethanol fermentation results for strains expressing GH5_15 and GH64 beta-glucanases in background strain MeJi797 treated without exogenous glucoamylase addition.

FIG. 10 and FIG. 11 show the results of strains expressing a GH5_15 and GH64 in background strain MeJi797 where tubes were treated with 0.42 AGU/g-DS of exogenous glucoamylase and no exogenous glucoamylase, respectively. None of the tested strains co-expressing GH5_15 and GH64 constructed in MeJi797 show an increase in ethanol compared to the control.

Figure 12:
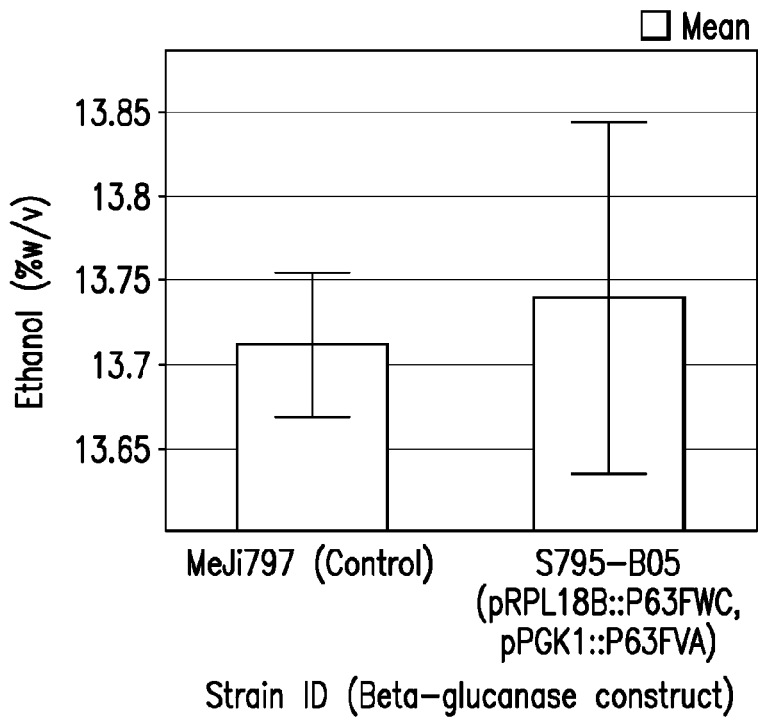
FIG. 12: Ethanol fermentation results for strains expressing GH5_15 and GH64 beta-glucanases in background strain S709-A06 treated with 0.42 AGU/g-DS of exogenous glucoamylase.
Figure 13:
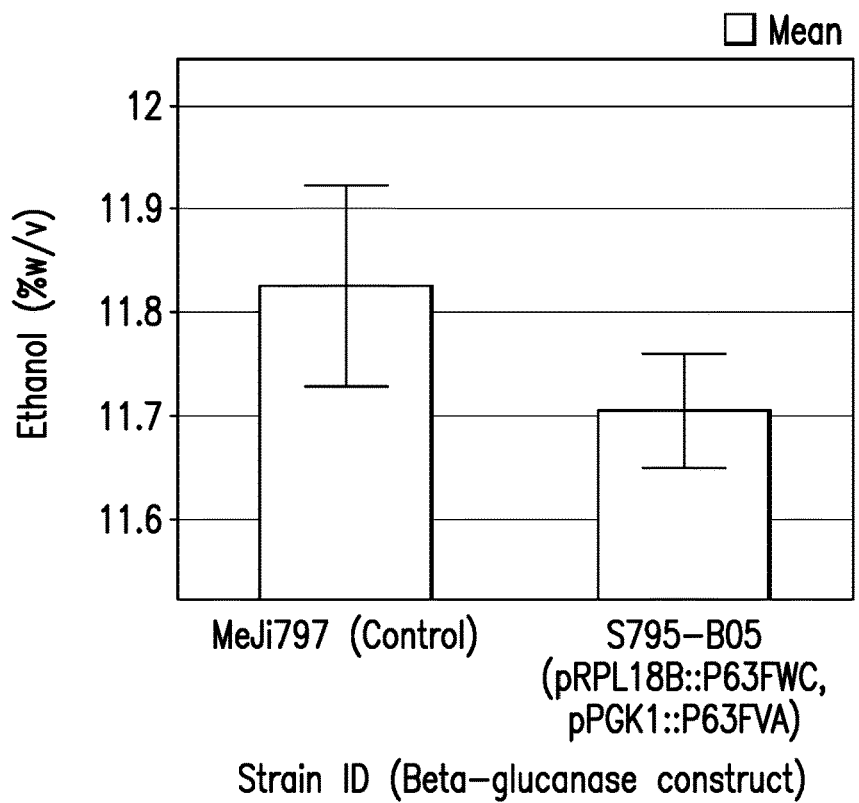
FIG. 13: Ethanol fermentation results for strains expressing GH5_15 and GH64 beta-glucanases in background strain S709-A06 treated without exogenous glucoamylase addition.

FIG. 12 and FIG. 13 show the results of strains expressing a GH5_15 and GH64 in background strain MeJi797 where tubes were treated with 0.42 AGU/g-DS of exogenous glucoamylase and no exogenous glucoamylase, respectively. None of the tested strains expressing GH5_15 and GH64 constructed in S709-A06 show an increase in ethanol compared to the control.

Figure 14:
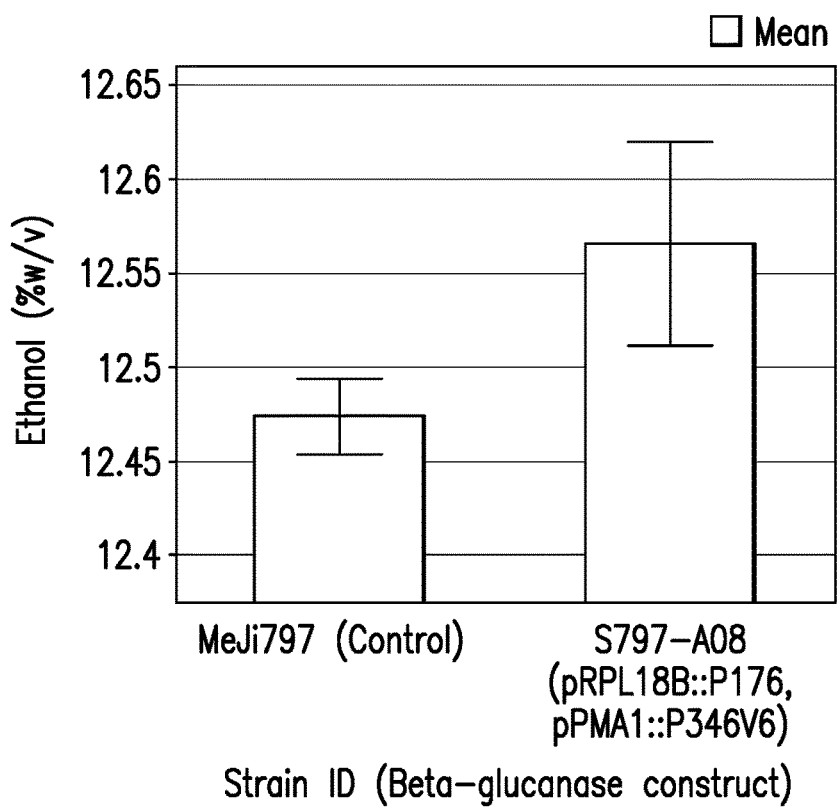
FIG. 14: Ethanol fermentation results for strains expressing GH5_15 and GH55_3 beta-glucanases in background strain MeJi797 treated with 0.42 AGU/g-DS of exogenous glucoamylase.
Figure 15:
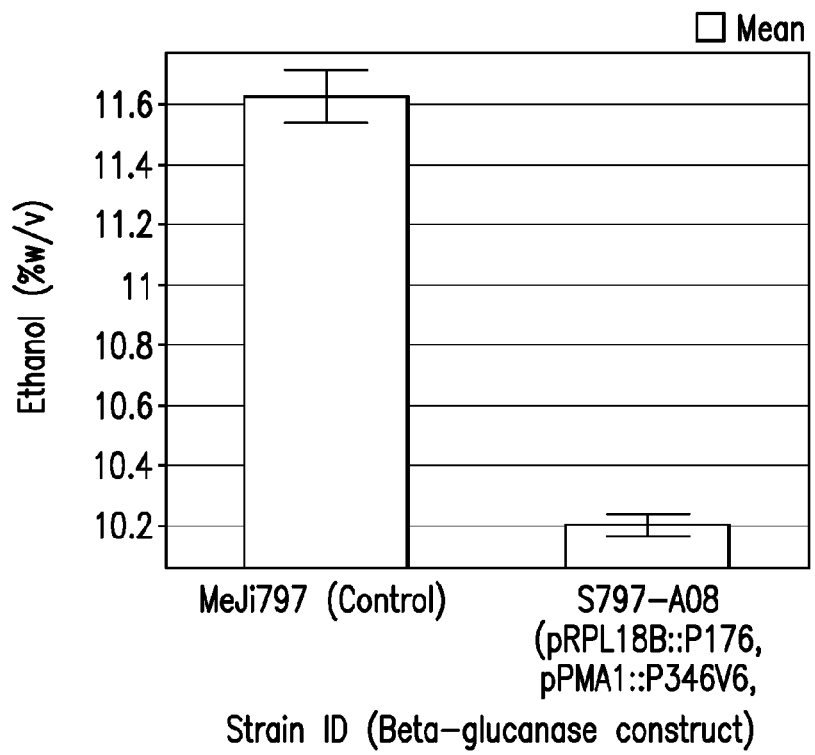
FIG. 15: Ethanol fermentation results for strains expressing GH5_15 and GH55_3 beta-glucanases in background strain MeJi797 treated without exogenous glucoamylase addition.

FIG. 14 and FIG. 15 show the results of strains expressing a GH5_15 and GH55_3 in background strain MeJi797 where tubes were treated with 0.42 AGU/g-DS of exogenous glucoamylase and no exogenous glucoamylase, respectively. Strain S797-A08, which co-expresses the beta-glucanase enzymes of SEQ ID NO: 2 and SEQ ID NO: 108 in MeJI797 shows an increase in ethanol of 0.09% compared to control in the 0.42 AGU/g-DS exogenous glucoamylase treatment.

Example 45: Construction of Yeast Strains Expressing Three Beta-Glucanases

This example describes the construction of yeast cells containing three beta-glucanase under the control of one of five *S. cerevisiae* promoters: pRPL18B, pADH1, pTEF2, pPGK1, and pPMA1. Seven pieces of DNA containing promoters, genes and terminators were designed to allow for homologous recombination among the seven DNA fragments and into the X-3 locus of the yeasts MeJi797 and S709-A06 (MeJi797 with *A. fumigatus* beta-glucosidase). The resulting strains have one 5' homology containing fragment with a promoter, three promoter and gene containing fragments, two terminator and promoter containing fragment, and one 3' homology fragment with a terminator integrated into the *S. cerevisiae* genome at the X-3 locus. Some of these fragments descriptions are found above under the examples above.

Construction of the pADH1 Containing Fragment with tTEF1 (Middle Fragment 14)

The linear DNA containing 143 bp homology to the *S. cerevisiae* tTEF1 terminator and the pADH1 promoter was PCR amplified from TP29 genomic DNA using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 µL. The PCR was performed in a T100™ Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pADH1 Promoter and *Trichoderma harzianum* GH30_3 Coding Sequence (Middle Fragment 15)

The linear DNA containing 50 bp homology to the *S. cerevisiae* pADH1 promoter was PCR amplified from S687-E07 genomic DNA using fifty pmoles each of forward and reverse primer was used in a PCR reaction containing 5 ng of plasmid DNA as template, 1× Platinum SuperFi HF Buffer (Thermo Fisher Scientific), and 2 units SuperFi DNA polymerase in a final volume of 50 µL. The PCR was performed in a T100m Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pADH1 Promoter and *Trichoderma* Atroviride GH30_3 Coding Sequence (Middle Fragment 16)

The linear DNA containing 50 bp homology to the *S. cerevisiae* pADH1 promoter was PCR amplified from S686-C07 genomic DNA using fifty pmoles each of forward and reverse primer was used in a PCR reaction containing 5 ng of plasmid DNA as template, 1× Platinum SuperFi HF Buffer (Thermo Fisher Scientific), and 2 units SuperFi DNA polymerase in a final volume of 50 µL. The PCR was performed in a T100m Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of the pTEF2 Containing Fragment with tSTE1 (Middle Fragment 17)

The linear DNA containing 200 bp homology to the *S. cerevisiae* tSTE1 terminator and the pTEF2 promoter was PCR amplified from TP60 genomic DNA using fifty pmoles each of forward and reverse primer was in a reaction containing 5 ng of plasmid DNA as template, 1× Platinum SuperFi HF Buffer (Thermo Fisher Scientific), and 2 units SuperFi DNA polymerase in a final volume of 50 µL. The PCR was performed in a T100m Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of Fragment with pTEF2 Promoter and *Trichoderma reesei* GH16 Coding Sequence (Middle Fragment 18)

The linear DNA containing 50 bp homology to the *S. cerevisiae* pTEF2 promoter was PCR amplified from S686-E08 genomic DNA using fifty pmoles each of forward and reverse primer was in a reaction containing 5 ng of plasmid DNA as template, 1× Platinum SuperFi HF Buffer (Thermo Fisher Scientific), and 2 units SuperFi DNA polymerase in a final volume of 50 µL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of the pTEF2 Containing Fragment with tPRM9 (Middle Fragment 19)

The linear DNA containing 250 bp homology to the *S. cerevisiae* tPRM9 terminator and the pTEF2 promoter was PCR amplified from TP21 genomic DNA using fifty pmoles each of forward and reverse primer was in a reaction containing 5 ng of plasmid DNA as template, 1× Platinum SuperFi HF Buffer (Thermo Fisher Scientific), and 2 units SuperFi DNA polymerase in a final volume of 50 µL. The PCR was performed in a T100™ Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Construction of the pPMA1 Containing Fragment with tPRM9 (Middle Fragment 20)

The linear DNA containing 250 bp homology to the *S. cerevisiae* tPRM9 terminator and the pPMA1 promoter was PCR amplified from TP22 genomic DNA using fifty pmoles each of forward and reverse primer in a reaction containing 5 ng of plasmid DNA as template, 1× Platinum SuperFi HF Buffer (Thermo Fisher Scientific), and 2 units SuperFi DNA polymerase in a final volume of 50 µL. The PCR was performed in a T100M Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

formed into the into *S. cerevisiae* strain MeJi797 following a yeast electroporation protocol. Transformants were selected on YPD+cloNAT to select for transformants that contain the Mad7 plasmid pMIBa647. Transformants were either picked manually by hand onto YPD plates or by using a Q-pix Colony Picking System (Molecular Devices) to inoculate 1 well of 96-well plate containing YPD media. The plates were grown for 2 days then glycerol was added to 20% final concentration and the plates were stored at −80° C. until needed. Integration of specific beta-glucanase construct was verified by PCR with locus specific primers and subsequent sequencing. The strains generated by transformation in MeJi797 are shown in Table 74.

TABLE 74

Strains with GH5_15, GH30_3, and GH16 beta-glucanase genes added in MeJi797

| Strain ID | Promoter 1 | β-glucanase1 (SEQ ID NO) | Promoter 2 | β-glucanase2 (SEQ ID NO) | Promoter 3 | β-glucanase3 (SEQ ID NO) |
|---|---|---|---|---|---|---|
| MeJi797 | — | — | — | — | — | — |
| S797-E11 | pRPL18B | 2 | pADH1 | 32 | pTEF2 | 23 |

Construction of the 3' X-3 Homology Containing Fragment with tENO2 (Right Fragment 3)

The linear DNA containing 500 bp homology to the X-3 site and the *S. cerevisiae* tENO2 terminator was PCR amplified from TH36 plasmid DNA using fifty pmoles each of forward and reverse primer was in a reaction containing 5 ng of plasmid DNA as template, 1× Platinum SuperFi HF Buffer (Thermo Fisher Scientific), and 2 units SuperFi DNA polymerase in a final volume of 50 µL. The PCR was performed in a T100™ Thermal Cycler (Bio-Rad Laboratories, Inc.) programmed for one cycle at 98° C. for 30 seconds followed by 35 cycles each at 98° C. for 10 seconds, 60° C. for 10 seconds, and 72° C. for 1.5 minutes with a final extension at 72° C. for 5 minutes. Following thermocycling, the PCR reaction products gel isolated and cleaned up using the QIAquick Gel Extraction kit (Qiagen).

Integration of Left, Middle, and Right-Hand Fragments to Generate Yeast Strains Expressing GH5_15, GH30_3, and GH16 Beta-Glucanase Strains The yeast MeJi797 was transformed with the left, middle and right integration fragments described above. In each transformation pool, the left fragment and right fragment with 50 ng of each fragment was used. There was one set of the left, middle, and one right fragment pools used: left fragment 1, middle fragments 14 and 17, and right fragment 3 (Blend 3 master mix). There was also six additional middle fragments consisting of a signal peptide and beta-glucanase gene with ~50 ng of each fragment (200 ng total). One of middle fragments 1-3, one of middle fragments 15-16, and middle fragment 18 were transformed in each construct. To aid homologous recombination of the left, middle and right fragments at the genomic X-3 sites a plasmid containing MAD7 and guide RNA specific to X-3 (pMIBa647) was also used in the transformation. These six middle components were combined with the Blend 3 master mix and trans- Integration of Left, Middle, and Right-Hand Fragments to Generate Yeast Strains Expressing GH5_15, GH64, and GH16 Beta-Glucanases The yeasts MeJi797 and S709-A06 were transformed with the left, middle and right integration fragments described above. In each transformation pool, the left fragment and right fragment with 50 ng of each fragment was used. There was one set of the left, middle, and one right fragment pools used: left fragment 1, middle fragments 4 and 19, and right fragment 3 (Blend 4 master mix). There are also six additional middle fragments consisting of a signal peptide and beta-glucanase gene with ~50 ng of each fragment (200 ng total). One of the middle fragments 1-3, one of middle fragments 10-11, and middle fragment 18 was transformed in each construct. To aid homologous recombination of the left, middle and right fragments at the genomic X-3 sites a plasmid containing MAD7 and guide RNA specific to X-3 (pMIBa647) was also used in the transformation. These six middle components were combined with the Blend 4 master mix and transformed into the into *S. cerevisiae* strains MeJi797 and S709-A06 following a yeast electroporation protocol. Transformants were selected on YPD+cloNAT to select for transformants that contain the Mad7 plasmid pMIBa647. Transformants were either picked manually by hand onto YPD plates or by using a Q-pix Colony Picking System (Molecular Devices) to inoculate one well of 96-well plate containing YPD media. The plates were grown for 2 days then glycerol was added to 20% final concentration and the plates were stored at −80° C. until needed. Integration of specific beta-glucanase construct was verified by PCR with locus specific primers and subsequent sequencing. The strains generated by transformation in MeJi797 and S709-A06 are in Tables 75 and 76, respectively.

TABLE 75

Strains with GH5_15, GH64, and GH16 beta-glucanase genes added in MeJi797

| Strain ID | Promoter 1 | β-glucanase1 (SEQ ID NO) | Promoter 2 | β-glucanase2 (SEQ ID NO) | Promoter 3 | β-glucanase3 (SEQ ID NO) |
|---|---|---|---|---|---|---|
| MeJi797 | — | — | — | — | — | — |
| S798-C08 | pRPL18B | 35 | pPGK1 | 11 | pTEF2 | 23 |
| S799-D01 | pRPL18B | 41 | pPGK1 | 17 | pTEF2 | 23 |

TABLE 76

Strains with GH5_15, GH64, and GH16 beta-glucanase genes added in S709-A06

| Strain ID | Promoter 1 | β-glucanase1 (SEQ ID NO) | Promoter 2 | β-glucanase2 (SEQ ID NO) | Promoter 3 | β-glucanase3 (SEQ ID NO) |
|---|---|---|---|---|---|---|
| S709-A06 | — | — | — | — | — | — |
| S796-H03 | pRPL18B | 2 | pPGK1 | 11 | pTEF2 | 23 |
| S796-A10 | pRPL18B | 41 | pPGK1 | 17 | pTEF2 | 23 |
| S796-D10 | pRPL18B | 41 | pPGK1 | 17 | pTEF2 | 23 |

Integration of Left, Middle, and Right-Hand Fragments to Generate Yeast Strains Expressing GH5_15, GH64, and GH55_3 Beta-Glucanases The yeasts MeJi797 and S709-A06 were transformed with the left, middle and right integration fragments described above. In each transformation pool, the left fragment and right fragment with 50 ng of each fragment was used. There was one set of the left, middle, and one right fragment pools used: left fragment 1, middle fragments 4 and 20, and right fragment 2 (Blend 5 master mix). There were also six additional middle fragments consisting of a signal peptide and beta-glucanase gene with ~50 ng of each fragment (200 ng total). One of middle fragments 1-3 one of middle fragments 10-11, and middle fragment 13 were transformed in each construct. To aid homologous recombination of the left, middle and right fragments at the genomic X-3 sites a plasmid containing MAD7 and guide RNA specific to X-3 (pMIBa647) was also used in the transformation. These six middle components were combined with the Blend 5 master mix and transformed into the into S. cerevisiae strains MeJi797 and S709-A06 following a yeast electroporation protocol. Transformants were selected on YPD+cloNAT to select for transformants that contain the Mad7 plasmid pMIBa647. Transformants were either picked manually by hand onto YPD plates or by using a Q-pix Colony Picking System (Molecular Devices) to inoculate one well of 96-well plate containing YPD media. The plates were grown for two days then glycerol was added to 20% final concentration and the plates were stored at −80° C. until needed. Integration of specific beta-glucanase construct was verified by PCR with locus specific primers and subsequent sequencing. The strains generated by transformation in MeJi797 and S709-A06 are shown in Tables 77 and 78, respectively.

TABLE 77

Strains with GH5_15, GH64, and GH55_3 beta-glucanase genes added in MeJi797

| Strain ID | Promoter1 | β-glucanase1 (SEQ ID NO) | Promoter2 | β-glucanase2 (SEQ ID NO) | Promoters3 | β-glucanase3 (SEQ ID NO) |
|---|---|---|---|---|---|---|
| MeJi797 | — | — | — | — | — | — |
| S799-B02 | pRPL18B | 35 | pPGK1 | 11 | pPMA1 | 108 |
| S799-C02 | pRPL18B | 35 | pPGK1 | 11 | pPMA1 | 108 |
| S799-F02 | pRPL18B | 41 | pPGK1 | 11 | pPMA1 | 108 |
| S799-G02 | pRPL18B | 41 | pPGK1 | 11 | pPMA1 | 108 |
| S799-H02 | pRPL18B | 41 | pPGK1 | 11 | pPMA1 | 108 |

TABLE 77-continued

Strains with GH5_15, GH64, and GH55_3 beta-glucanase genes added in MeJi797

| Strain ID | Promoter1 | β-glucanase1 (SEQ ID NO) | Promoter2 | β-glucanase2 (SEQ ID NO) | Promoters3 | β-glucanase3 (SEQ ID NO) |
|---|---|---|---|---|---|---|
| S797-B05 | pRPL18B | 2 | pPGK1 | 17 | pPMA1 | 108 |
| S797-G05 | pRPL18B | 35 | pPGK1 | 17 | pPMA1 | 108 |
| S797-A06 | pRPL18B | 41 | pPGK1 | 7 | pPMA1 | 108 |
| S797-C06 | pRPL18B | 41 | pPGK1 | 17 | pPMA1 | 108 |
| S797-D06 | pRPL18B | 41 | pPGK1 | 17 | pPMA1 | 108 |

TABLE 78

Strains with GH5_15, GH64, and GH55_3 beta-glucanase genes added in S709-A06.

| Strain ID | Promoter1 | β-glucaase1 (SEQ ID NO) | Promoter2 | β-glucanase2 (SEQ ID NO) | Promoter3 | β-glucanase3 (SEQ ID NO) |
|---|---|---|---|---|---|---|
| S709-A06 | — | — | — | — | — | — |
| S796-E11 | pRPL18B | 41 | pPGK1 | 11 | pPMA1 | 108 |
| S796-F11 | pRPL18B | 41 | pPGK1 | 11 | pPMA1 | 108 |
| S796-G11 | pRPL18B | 41 | pPGK1 | 11 | pPMA1 | 108 |
| S796-H11 | pRPL18B | 41 | pPGK1 | 11 | pPMA1 | 108 |
| S795-C03 | pRPL18B | 2 | pPGK1 | 17 | pPMA1 | 108 |

Example 46: Fermentation Performance of Yeast Strains Expressing Three Beta-Glucanases This example describes the evaluation of yeast strains expressing three beta-glucanases on final ethanol titer in a corn mash fermentation.

Preparation of Yeast Culture for Tube Fermentations

Yeast strains were incubated overnight in YPD media (6% w/v D-glucose, 2% peptone, 1% yeast extract) at 32° C. for a total of 18 hours at 150 rpm at 32° C. Cells were harvested at ~18 hours, the cultures were centrifuged at 3500 rpm for 5 minutes, and the supernatant was discarded. Cells were suspended in ~10 mL tap water, and total yeast concentration was determined using a YC-100 Nucleocounter. Industrially obtained liquefied corn mash, where liquefaction was carried out using Liquozyme Pro, was supplemented with 3 ppm lactrol and 500 ppm of urea. Simultaneous saccharification and fermentation (SSF) was performed via mini-scale fermentations. Approximately 5 g of liquefied corn mash was added to 15 mL conical tubes. Tubes were dosed with either 0.42 AGU/g of dry solids of an exogenous glucoamylase blend Glucoamylase BL2 or no exogenous glucoamylase blend followed by the addition of yeast expressing three beta-glucanases. 10^6 yeast cells/g of corn mash were pitched. As control, MeJi797 (yeast without expression of beta-glucanase) was pitched at 10^6 cells/g of corn mash. Glucoamylase and yeast dosages were administered based on the exact weight of corn slurry in each tube. Tubes were incubated at 32° C. Triplicates of each strain were analyzed after 65 hour fermentations. Fermentations were stopped by addition of 50 uL of 40% $H_2SO_4$, followed by centrifuging, and filtration through a 0.2 micron filter. Ethanol, oligosaccharides, glucose, and organic acids concentrations were determined using HPLC. Reaction conditions are summarized in Table 79.

TABLE 79

Mini-tube fermentation reaction conditions.

| | |
|---|---|
| Substrate | Liquozyme Pro corn mash |
| Yeast pitch | 10^6 cells/g corn mash |
| Exogenous glucoamylase product dose | 0.42 AGU/g-DS or no addition (0 AGU/g-DS) |
| pH | 5.2 |
| Incubation temperature | 32° C. |
| Reaction time | 65 hours |

Fermentation Results

Figure 16:
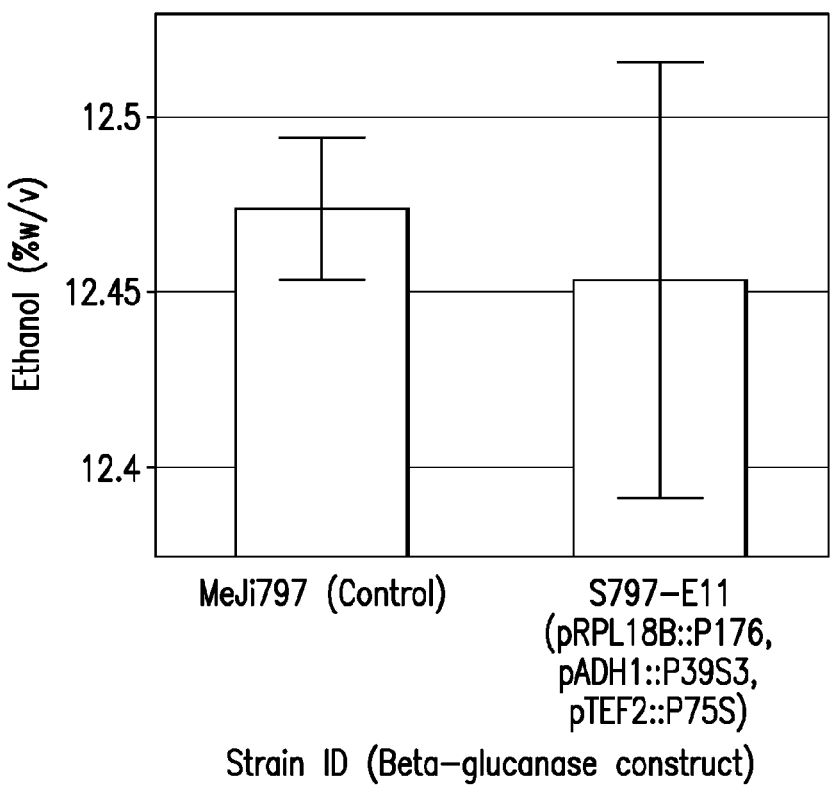
FIG. 16: Ethanol fermentation results for strains expressing GH5_15, GH30_3, and GH16 beta-glucanases in background strain MeJi797 treated with 0.42 AGU/g-DS of exogenous glucoamylase.
Figure 17:
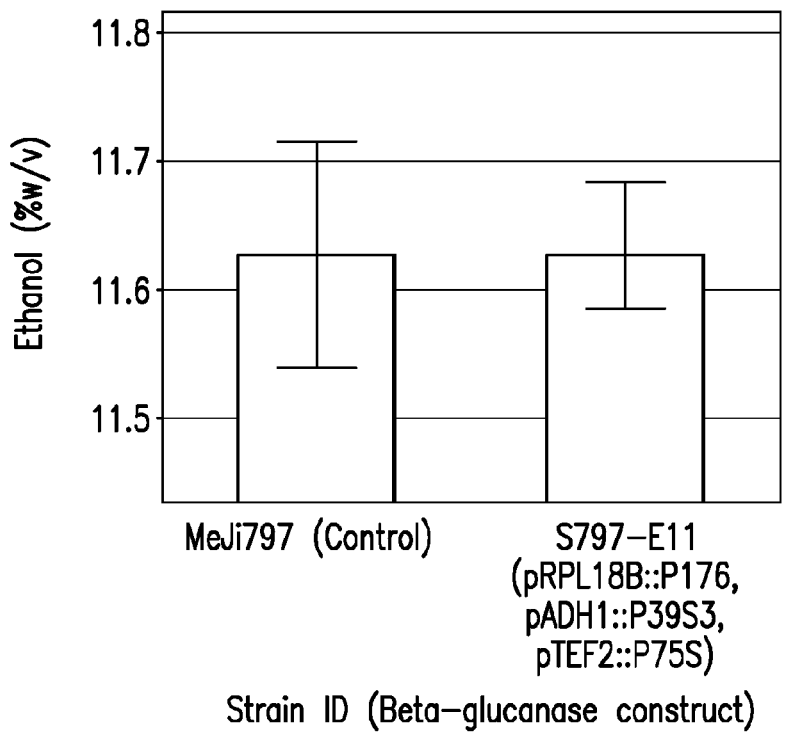
FIG. 17: Ethanol fermentation results for strains expressing GH5_15, GH30_3, and GH16 beta-glucanases in background strain MeJi797 treated without exogenous glucoamylase addition.

FIG. 16 and FIG. 17 show the results of strains expressing a GH5_15, GH30_3, and GH16 in background strain MeJi797 where tubes were treated with 0.42 AGU/g-DS of exogenous glucoamylase and no exogenous glucoamylase, respectively. None of the tested strains expressing GH5_15, GH30_3, and GH16 in MeJi797 show an increase in ethanol compared to the control.

Figure 18:
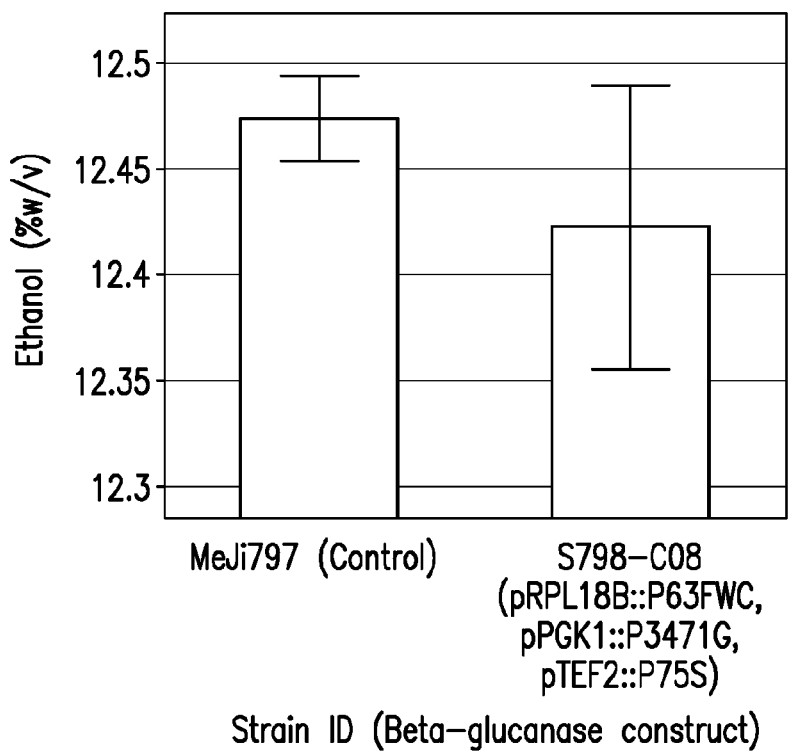
FIG. 18: Ethanol fermentation results for strains expressing GH5_15, GH64, and GH16 beta-glucanases in background strain MeJi797 treated with 0.42 AGU/g-DS of exogenous glucoamylase.
Figure 19:
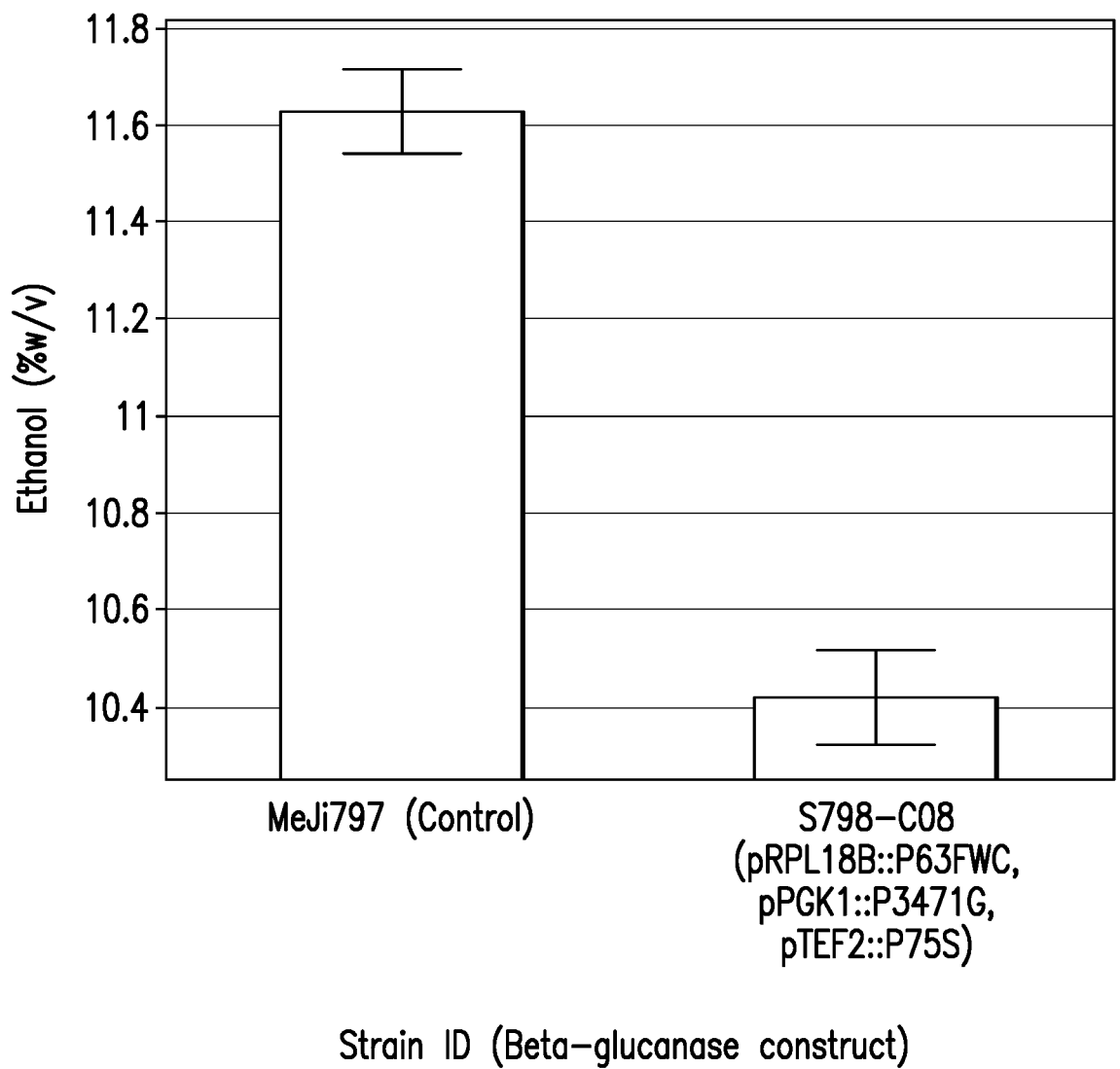
FIG. 19: Ethanol fermentation results for strains expressing GH5_15, GH64, and GH16 beta-glucanases in background strain MeJi797 treated without exogenous glucoamylase addition.

FIG. 18 and FIG. 19 show the results of strains expressing a GH5_15, GH64, and GH16 in background strain MeJi797 where tubes were treated with 0.42 AGU/g-DS of exogenous glucoamylase and no exogenous glucoamylase, respectively. None of the tested strains expressing GH5_15, GH64, and GH16 in MeJi797 show an increase in ethanol compared to the control.

Figure 20:
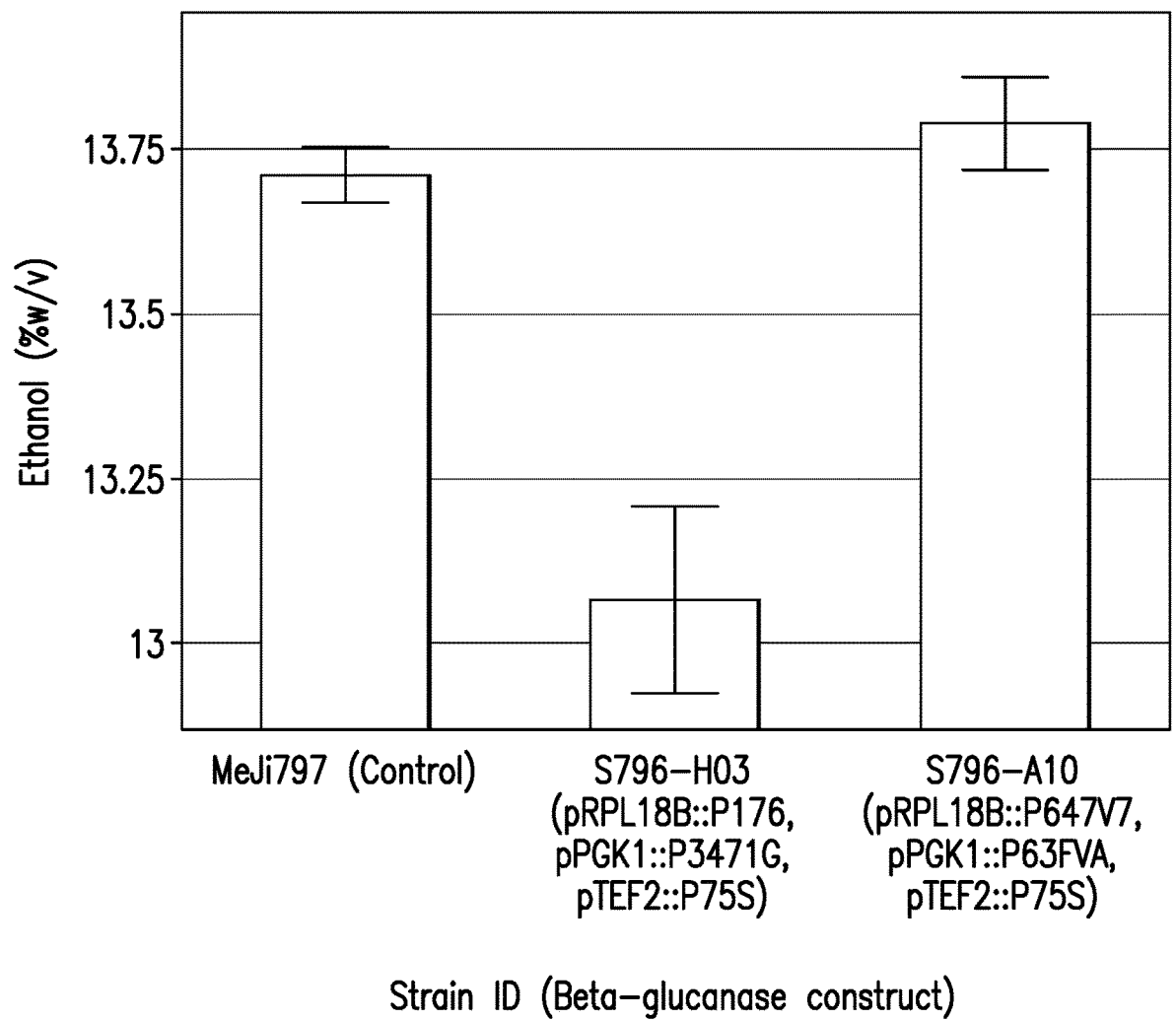
FIG. 20: Ethanol fermentation results for strains expressing GH5_15, GH64, and GH16 beta-glucanases in background strain S709-A06 treated with 0.42 AGU/g-DS of exogenous glucoamylase.
Figure 21:
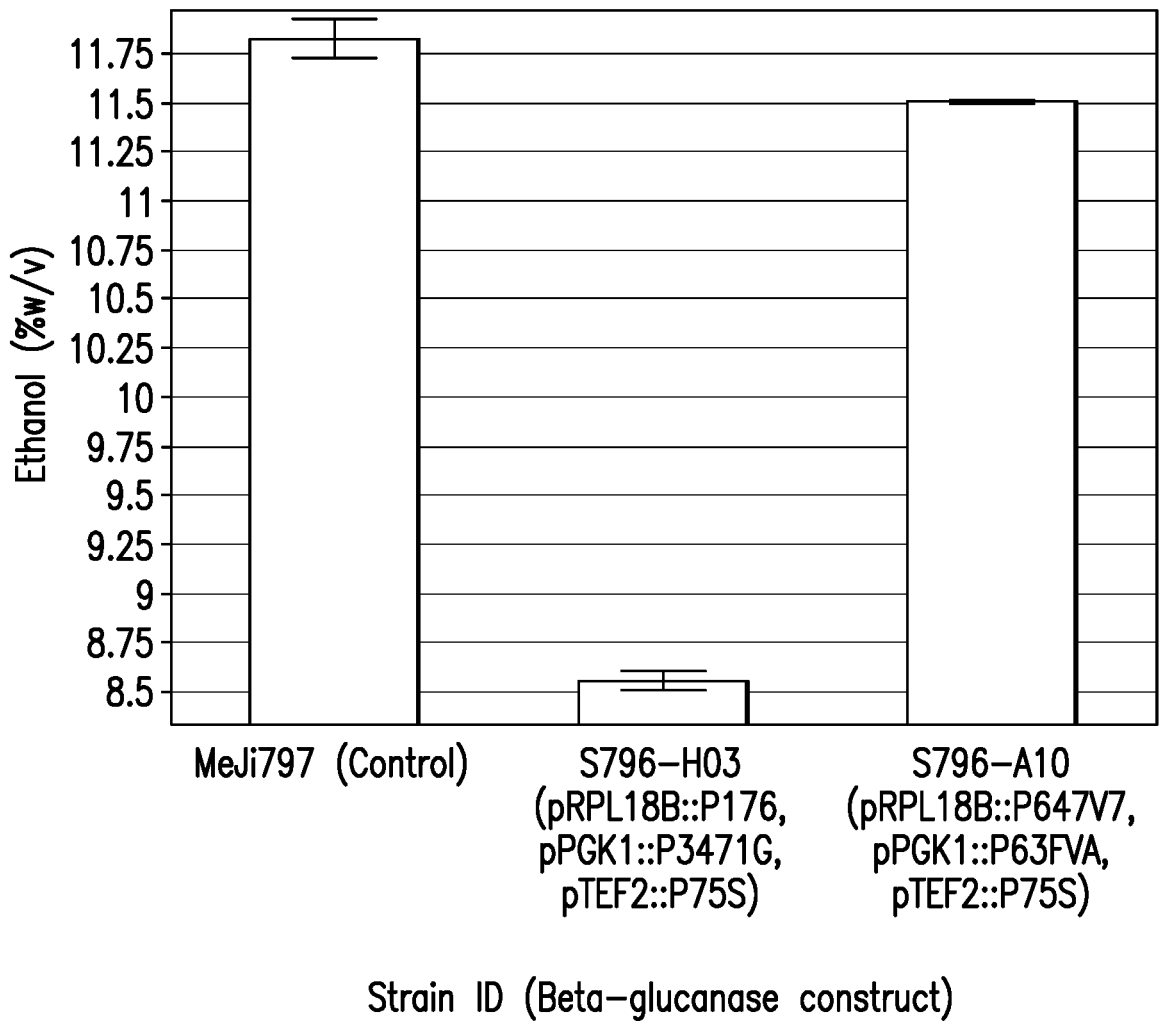
FIG. 21: Ethanol fermentation results for strains expressing GH5_15, GH64, and GH16 beta-glucanases in background strain S709-A06 treated without exogenous glucoamylase addition.

FIG. 20 and FIG. 21 show the results of strains expressing a GH5_15, GH64, and GH16 in background strain S709-A06 where tubes were treated with 0.42 AGU/g-DS of exogenous glucoamylase and no exogenous glucoamylase, respectively. None of the strains expressing GH5_15, GH64, and GH26 in S709-A06 show an increase in ethanol compared to the control.

Figure 22:
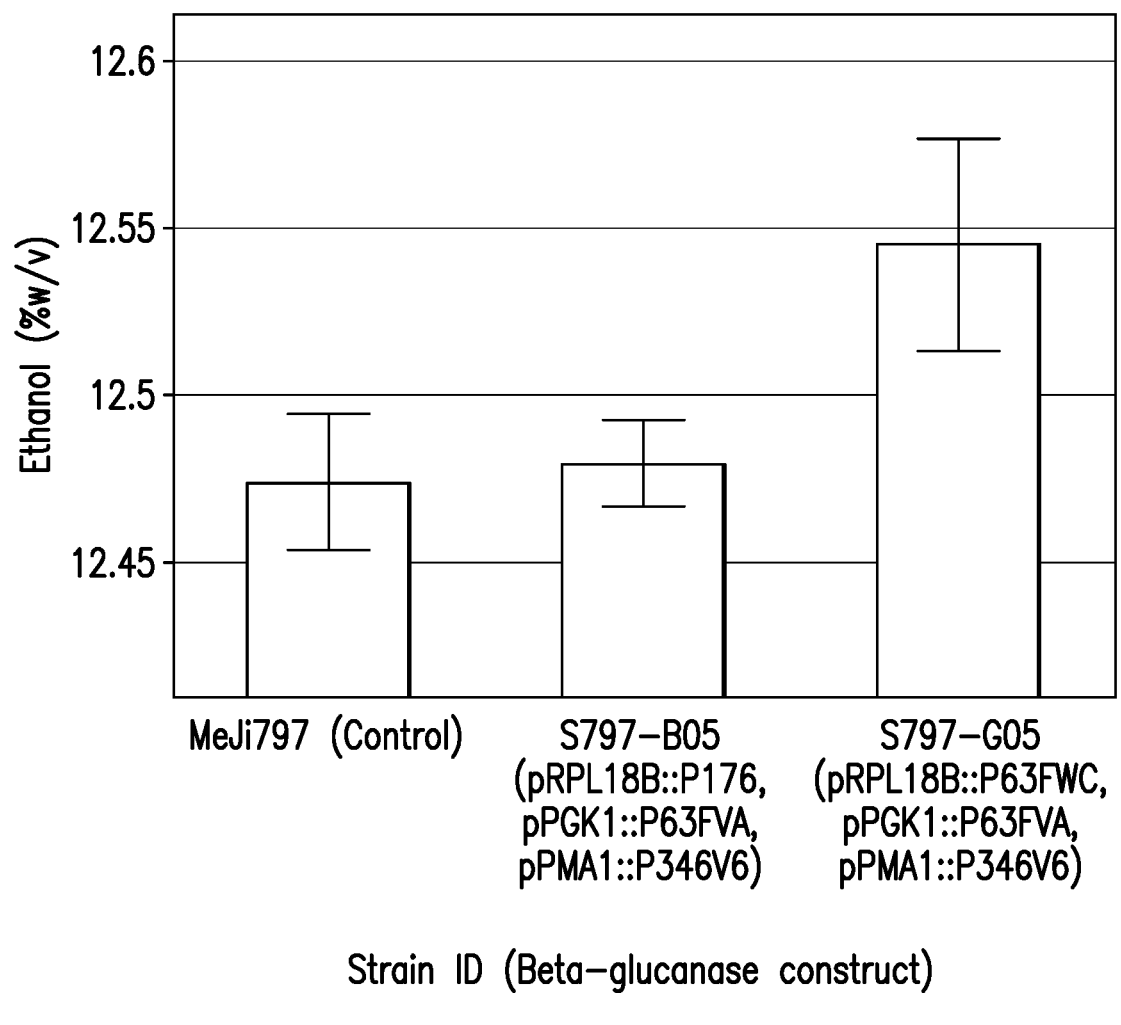
FIG. 22: Ethanol fermentation results for strains expressing GH5_15, GH64, and GH55_3 beta-glucanases in background strain MeJi797 treated with 0.42 AGU/g-DS of exogenous glucoamylase.
Figure 23:
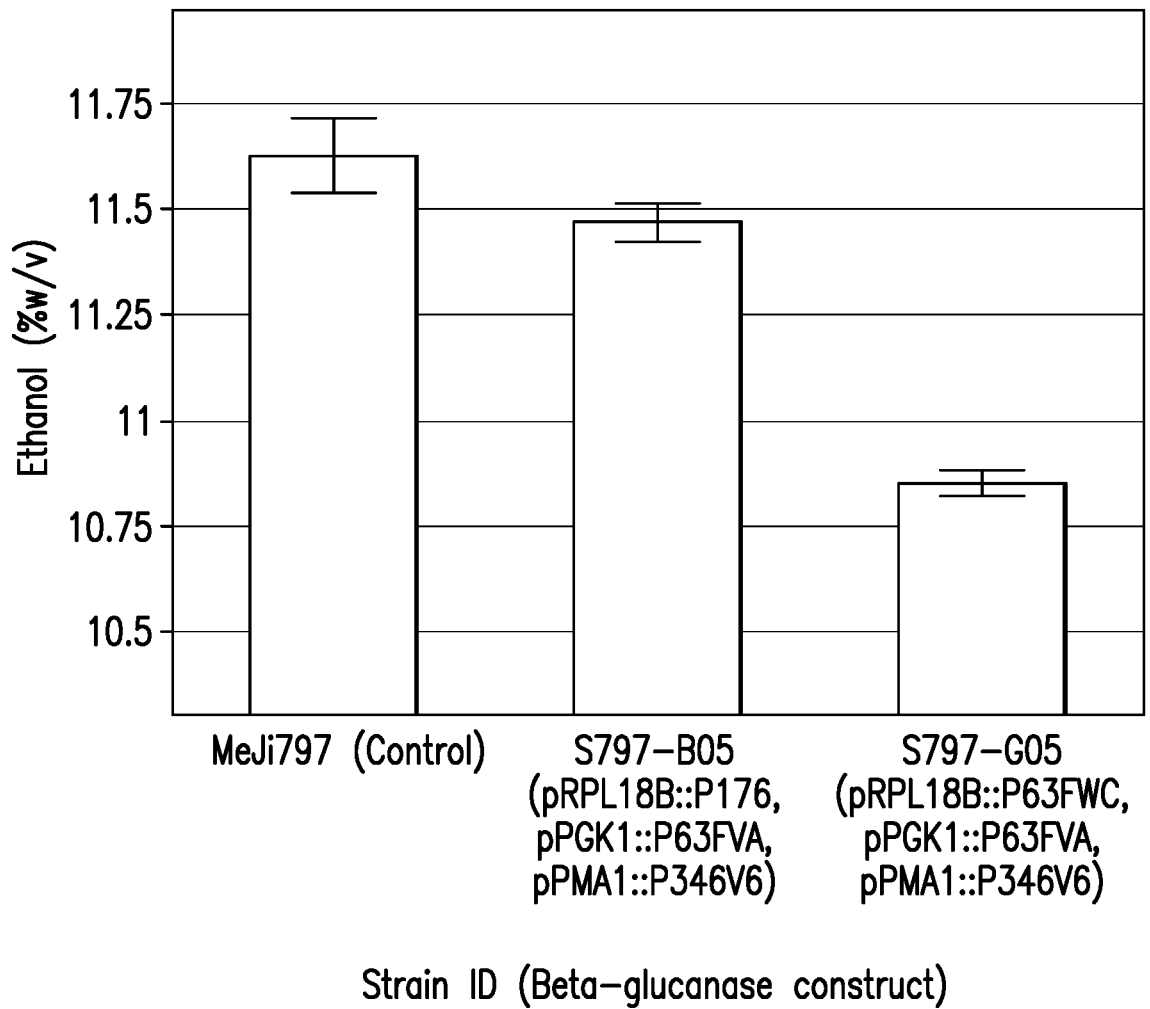
FIG. 23: Ethanol fermentation results for strains expressing GH5_15, GH64, and GH55_3 beta-glucanases in background strain MeJi797 treated without exogenous glucoamylase addition.

FIG. 22 and FIG. 23 show the results of strains expressing a GH5_15, GH64, and GH55_3 in background strain MeJi797 where tubes were treated with 0.42 AGU/g-DS of exogenous glucoamylase and no exogenous glucoamylase, respectively. Strain S797-G05, which expresses the beta-glucanases of SEQ ID NO: 35, SEQ ID NO: 17, and SEQ ID NO: 108, shows an improvement in ethanol of 0.07% w/v over the control MeJi797, in the tubes treated with 0.42 AGU/g-DS of glucoamylase.

Figure 24:
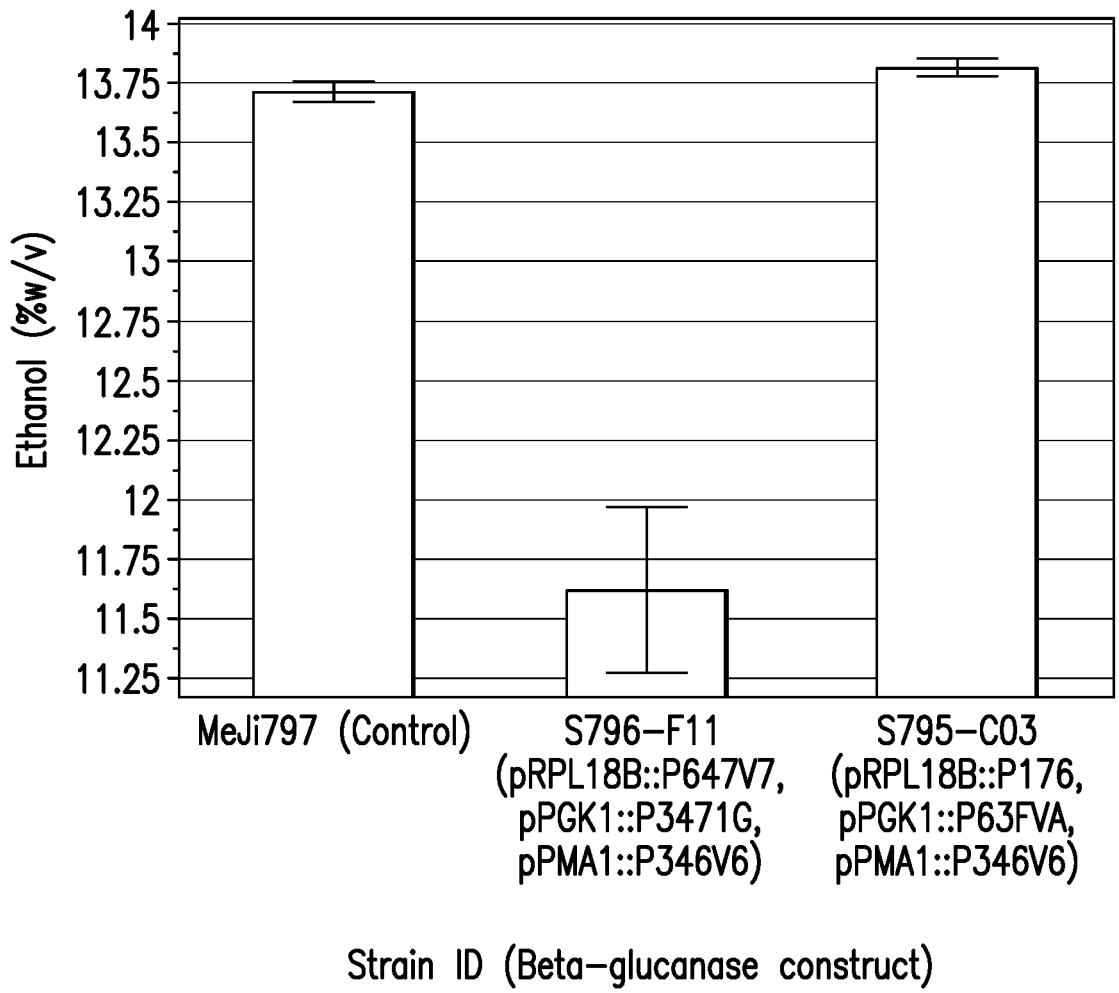
FIG. 24: Ethanol fermentation results for strains expressing GH5_15, GH64, and GH55_3 beta-glucanases in background strain S709-A06 treated with 0.42 AGU/g-DS of exogenous glucoamylase.
Figure 25:
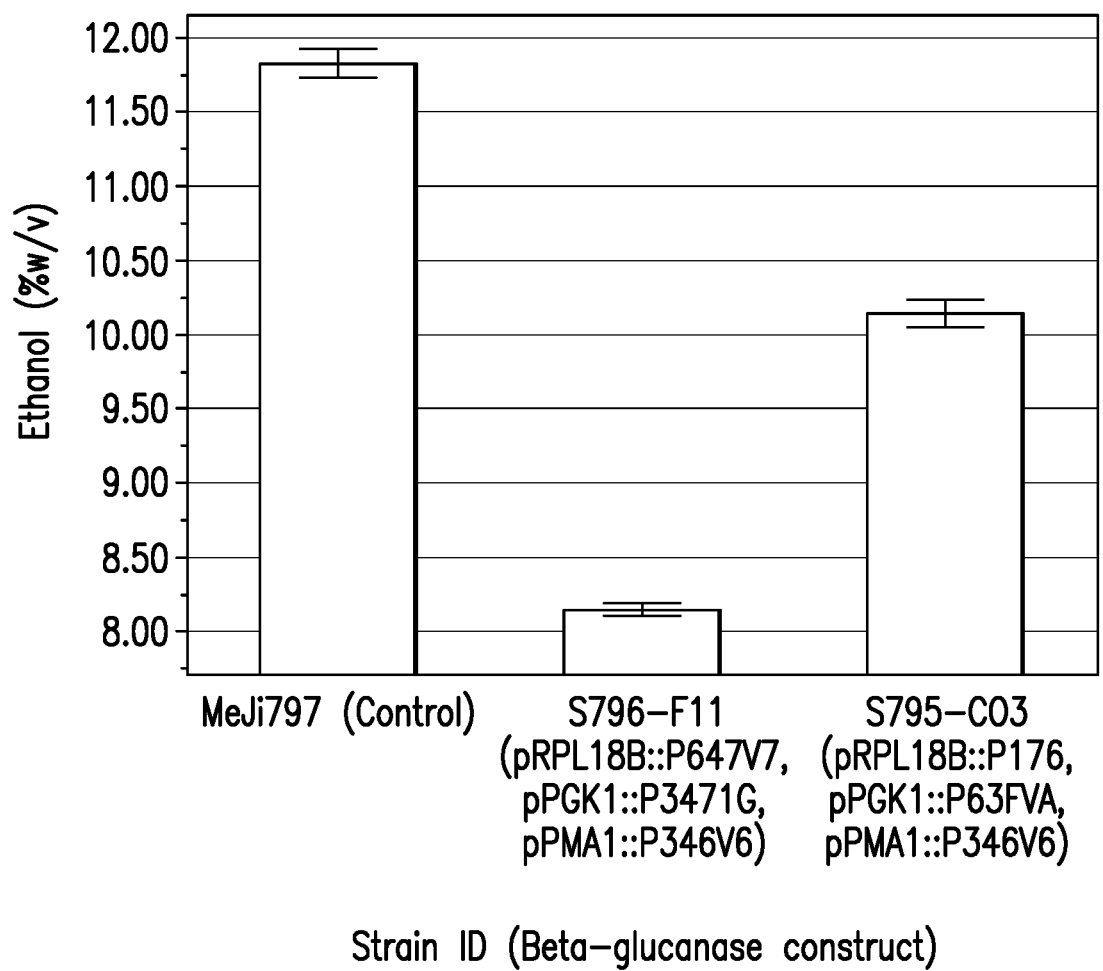
FIG. 25: Ethanol fermentation results for strains expressing GH5_15, GH64, and GH55_3 beta-glucanases in background strain S709-A06 treated without exogenous glucoamylase addition.

FIG. 24 and FIG. 25 show the results of strains expressing a GH5_15, GH64, and GH55_3 in background strain S709-A06 where tubes were treated with 0.42 AGU/g-DS of exogenous glucoamylase and no exogenous glucoamylase, respectively. None of the tested strains expressing GH5_15, GH64, and GH55_3 constructed in S709-A06 show an increase in ethanol compared to the control.

Example 47: Characterization of the GH55_3 Beta-Glucanase from *Trichoderma harzianum* (SEQ ID NO: 107)

The beta-glucanase assay described in Example 5 was used for obtaining the activity for the GH55_3 beta-glucanase from *Trichoderma harzianum* (SEQ ID NO: 107). The assay was performed using 2 g/L scleroglucan as a substrate; 24 hours, pH 5, 40° C., in 50 mM sodium acetate buffer, 5 mM GDL. The polypeptide of SEQ ID NO: 107 showed enzyme activity as shown in Table 80. Specific activity of the polypeptide of SEQ ID NO: 107 on scleroglucan was found to be 0.003 BGU/mg protein.

TABLE 80

| Enzyme dose, mg protein/L | Average RS, mM | StDev |
|---|---|---|
| 160.0 | 0.628 | 0.001 |
| 80.0 | 0.353 | 0.012 |
| 40.0 | 0.186 | 0.005 |
| 20.0 | 0.113 | 0.021 |

The invention described and claimed herein is not to be limited in scope by the specific aspects herein disclosed, since these aspects are intended as illustrations of several aspects of the invention. Any equivalent aspects are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

SEQUENCE LISTING (154 sequences)

SEQ ID NO: 1 - DNA, 1290 bp, Trichoderma harzianum
  sig_peptide (1)..(51)
  CDS (1)..(1290)
atgaagtactccatcgttgctccggccattctcgccggcaccggctttgcgtggctgcctcaagaccgcgacctgaaggccttcaaccagacccctcgttttgaggagcttggcaagcgctttgagcctgcccttgcttctggtatcaccaagatccgtggtgtcaacttcggtggatggcttatcagcgagccatggatgatgtccaatgagtggaacaacaacatgggctgcaacggtgctgcctctgagttcgattgcatgcgcaacaactacatgggcagcaagcgtgctaccggaaacaccaagttccagaaccactacagggactggattaaccccgccaccgttcagtctgttcacgatgtcggcttgaacactatccgtatccccatcggctactggtcctacaacgccattgtcgacacggctagcgagccgtttgctgatggcaacctccagcttccgtaccttgatgctgttgttcagaaggccgctgatctcggaatctacgtcatcattgatcttcacggcgcccctggtggtcagcaacaggacgcctttaccggccagaaccccaaccccgccggtttctacaacacctacgactatggtcgtgctgagaagtggctgtcttggatgacaaaccgcatccacaccaaccctgcctactcgactgttggtatgattgaggttctcaacgagcctgtctccagacacgatggaggtggtcgctaccctgctcctggccaggacccaagcatggtccagacctactaccccggcgccctcaaggctgttcgtgatgccgaggctgcgctgaacgtcccaagcaacaagaagctgcacgtgcagttcatgtccagcaagtgggattctggtgatcctcgcagcaacgccgccgtcaagaacgaccccatggttggctttgacgaccacaactacattggctttgccctccagaacactggcgaccagtactctctcatgcacagtgcctgcactgactctcgtgtcgtgagcggccaggactttgccatcactggcgagtggagcatgacttctggtgccgactggcatgacggaaacttcttcaccaagttcttcacagctcagcagcagctgtatgagtcccctggaatggacggatggatctactggacctggaagaccgagctaaacgacccccgatggacctactcttatgctacctacctcaactacatcccaactaacgccgctgccctgcagcagaacgtttaccaggatgtctgcgctggattcaggtaa

SEQ ID NO: 2 - protein, 429 aa, Trichoderma harzianum
MKYSIVAPAILAGTGFAWLPQDRDLKAFNQTPRFEELGKRFEPALASGITKIRGVNFGGWLISEPWMMSNEWNNNMGCNGAASEFDCMRNNYMGSKRATGNTKFQNHYRDWINPATVQSVHDVGLNTIRIPIGYWSYNAIVDTASEPFADGNLQLPYLDAVVQKAADLGIYVIIDLHGAPGGQQQDAFTGQNPNPAGFYNTYDYGRAEKWLSWMTNRIHTNPAYSTVGMIEVLNEPVSRHDGGGRYPAPGQDPSMVQTYYPGALKAVRDAEAALNVPSNKKLHVQFMSSKWDSGDPRSNAAVKNDPMVGFDDHNYIGFALQNTGDQYSLMHSACTDSRVVSGQDFAITGEWSMTSGADWHDGNFFTKFFTAQQQLYESPGMDGWIYWTWKTELNDPRWTYSYATYLNYIPTNAAALQQNVYQDVCAGFR

SEQ ID NO: 3 - protein, 412 aa, Trichoderma harzianum
WLPQDRDLKAFNQTPRFEELGKRFEPALASGITKIRGVNFGGWLISEPWMMSNEWNNNMGCNGAASEFDCMRNNYMGSKRATGNTKFQNHYRDWINPATVQSVHDVGLNTIRIPIGYWSYNAIVDTASEPFADGNLQLPYLDAVVQKAADLGIYVIIDLHGAPGGQQQDAFTGQNPNPAGFYNTYDYGRAEKWLSWMTNRIHTNPAYSTVGMIEVLNEPVSRHDGGGRYPAPGQDPSMVQTYYPGALKAVRDAEAALNVPSNKKLHVQFMSSKWDSGDPRSNAAVKNDPMVGFDDHNYIGFALQNTGDQYSLMHSACTDSRVVSGQDFAITGEWSMTSGADWHDGNFFTKFFTAQQQLYESPGMDGWIYWTWKTELNDPRWTYSYATYLNYIPTNAAALQQNVYQDVCAGFR

SEQ ID NO: 4 - DNA, 2289 bp, Trichoderma harzianum
  sig_peptide (1)..(51)
  CDS (1)..(2289)
atgttgaagctcacggcgctcgttgcgctcttgctgggcgcggcgtcagctacgccgactcctagccctcctgccagcgatgagggcatcaccaagcgtgccaccagcttctattaccctaacatggaccatgttaatgcgcccaggggtttcgctcctgacttggatggcgacttcaattacccaatctatcagactgtcaacgcaggagatggaaatgctctccagaatgctatcaccactgatggaaagggtggctctcgtcacccacagtggtttgcttcacagccacgagttgtttacattcccccgggaacatatactatctccaagactctgagattcaacactgataccattttaatgggtgacccaactaatcctcccattattaaggctgctgccggtttctcaggcgatcagactcttatcagtgctcaagacccctccaccaacgagaagggagagctttctttcgccgtagctattaagaacgtggtattggacactaccgctataccaggtggaaattcatttactgccctatggtggggtgttgctcaagctgcgcatctgcagaatgtacgcattactatgagttcctcttcgggtggaaacggccataccggcatccggatgggtcgcggctcaacactcggcctcgccgacgttcgcgttgaacgcggccagaacggtatttggattgatggacatcaacaagcatcatttcacaacatttatttctttcaaaatactataggcatgctcatcagcagtggcaataccttcagcattttctcgtcgaccttcgacacctgtggaaccgcatttccaacactggccggttcaccctggattgccctgattgacgcaaagtcaattaactctggtgttacctttacgaccaatcaatttccttcatttatgattgagaatctgactaaagataatggcacacctgtcgttgttgtccgaggctcaactttggttggcgcttccagccatgtcaacacttactcttacggcaacaccgtgggcagaaaccctacttacggcgatgttacgtctagtaacacgagacctagtgctcttgctcctggtggtcgttacccttatgtggctcccccaacttatggagatttgcccatctcgagcttcctcaacgtcaaggacccagcgcagaatggaaaccgtcaagttaagggggataacacaatcaatgaagcagacacacttaatgccatcctggaacttgcagcaagccagaataaggttgcttattttccttttggcaagtaccgggtggattccacgcttttcatccctaagggttcccgtatcgtgggtgaggcttgggccaccatcaccggcaacggcaactttttcaagaacgaaaacagcccacaacccgttgtctcagttggccgtgcaggcgatgttggaattgcacagctgcaagatctaagagtcacgactaacgatgtgctccccggcgctatcctcgtacagttcaatatggctggcaataaccctggtgatgttgctctttggaactctttggtcaccgttggtggcacacgaggtgctcaagccttggctaatgcttgtaccaacaatagcaatgaatgtaagggtgctttcattggtatccacgtggcgaagggatcatctccttacattcaaaacgtttgggaacttgggttgcgggatcacatcgctgagaacttcagtggcggcacctcccatcgcagggaaaggtggaattttggtccaatccgacgaaacgcaacgtgtctttatcccataggaagtgggcattggtggttgtaccaactcaatcttcacaatgccgccaacgttgttgtgtctctgcttcaggcggagaccaactaccatcaaggcgccaacacgcagcagattcctcccgctccttgggttgcaaatgttggcacttggggcgatcctgatttctcttggtgcaacggtggcgataaacgatgccgtatgggccctgcaaacttcatcaacggaggttccaacatctacacatatgcctccgcggcatgggctttcttcagcggccctggccagggttgcgctcaattcgaatgtcaacaaaccatccactggattgccagcaccccaagcaaccttcaggcttttggactctgctccaaggattccgtcaacacactgcgtctgggcgacggcacatttatcaacacccagaatggatacactggcggctggactcccggaggtggtgacgttgcccgttatactacttaa

SEQ ID NO: 5 - protein, 762 aa, Trichoderma harzianum
MLKLTALVALLLGAASATPTPSPPASDEGITKRATSFYYPNMDHVNAPRGFAPDLDGDFNYPIYQTVNAGDGNALQNAITTDGKGGSRHPQWFASQPRVVYIPPGTYTISKTLRFNTDTILMGDPTNPPIIKAAAGFSGDQTLISAQDPSTNEKGELSFAVAIKNVVLDTTAIPGGNSFTALWWGVAQAAHLQNVRITMSSSSGGNGHTGIRMGRGSTLGLADVRVERGQNGIWIDGHQQASFHNIYFFQNTIGMLISSGNTFSIFSSTFDTCGTAFPTLAGSPWIALIDAKSINSGVTFTTNQFPSFMIENLTKDNGTPVVVVRGSTLVGASSHVNTYSYGNTVGRNPTYGDVTSSNTRPSALAPGGRYPYVAPPTYGDLPISSFLNVKDPAQNGNRQVKGDNTINEADTLNAILELAASQNKVAYFPFGKYRVDSTLFIPKGSRIVGEAWATITGNGNFFKNENSPQPVVSVGRAGDVGIAQLQDLRVTTNDVLPGAILVQFNMAGNNPGDVALWNSLVTVGGTRGAQALANACTNNSNECKGAFIGIHVAKGSSPYIQNVWELGLRDHIAENFSGGTSHRRERWNFGPIRRNATCLYPIGSGHWWLYQLNLHNAANVVVSLLQAETNYHQGANTQQIPPAPWVANVGTWGDPDFSWCNGGDKRCRMGPANFINGGSNIYTYASAAWAFFSGPGQGCAQFECQQTIHWIASTPSNLQAFGLCSKDSVNTLRLGDGTFINTQNGYTGGWTPGGGDVARYTT

SEQ ID NO: 6 - protein, 745 aa, Trichoderma harzianum
TPTPSPPASDEGITKRATSFYYPNMDHVNAPRGFAPDLDGDFNYPIYQTVNAGDGNALQNAITTDGKGGSRHPQWFASQPRVVYIPPGTYTISKTLRFNTDTILMGDPTNPPIIKAAAGFSGDQTLISAQDPSTNEKGELSFAVAIKNVVLDTTAIPGGNSFTALWWGVAQAAHLQNVRITMSSSSGGNGHTGIRMGRGSTLGLADVRVERGQNGIWIDGHQQASFHNIYFFQNTIGMLISSGNTFSIFSSTFDTCGTAFPTLAGSPWIALIDAKSINSGVTFTTNQFPSFMIENLTKDNGTPVVVVRGSTLVGASSHVNTYSYGNTVGRNPTYGDVTSSNTRPSALAPGGRYPYVAPPTYGDLPISSFLNVKDPAQNGNRQVKGDNTINEADTLNAILELAASQNKVAYFPFGKYRVDSTLFIPKGSRIVGEAWATITGNGNFFKNENSPQPVVSVGRAGDVGIAQLQDLRVTTNDVLPGAILVQFNMAGNNPGDVALWNSLVTVGGTRGAQALANACTNNSNECKGAFIGIHVAKGSSPYIQNVWELGLRDHIAENFSGGTSHRRERWNFGPIRRNATCLYPIGSGHWWLYQLNLHNAANVVVSLLQAETNYHQGANTQQIPPAPWVANVGTWGDPDFSWCNGGDKRCRMGPANFINGGSNIYTYASAAWAFFSGPGQGCAQFECQQTIHWIASTPSNLQAFGLCSKDSVNTLRLGDGTFINTQNGYTGGWTPGGGDVARYTT

SEQ ID NO: 7 - DNA, 1143 bp, Trichoderma harzianum
  CDS (1)..(1143)
atgacgccaactaccctcagcgtcgtggtcaaaaacaactcgaatgcctcgcagctctacgcctacgtcaccggccgcgcagctcagggcctcttcttcctcagcgccgacggcaccacgccgtacttccctacttcgccatcgtccaccttgcagcctctcgcaaaggactgcgccgtggccattggcgggccgggccggagccgcacgctgacggtgccgcggctggacggggcgcgggtctggttcagccaggagtcgccgctgacgtttcttgtcaacccgggcccggcggtggtggagccgtcggcgacgaatccggcggacccgaattataatattagatgggcgtttgcggagtttacgttgaatgaggctgagctgtatgtcaatgtgtcgtatgttgatttctttagtgtgccggtgtcgttgaggttggagaatggggcgggcaaggtgacgagtgtggatgggatgccggcgggtgcgttggatgagatttgtggcaagttgaaggcgcaggcgggcgtggataaggcgggatgggatcggttggttgtgactcaggctggggggagtgggcagaacttgcgtgctttgagtcccaactcggggagggtcatgttccagggcttgtttgacgggtactatcgcccatacgtggacgccgtgtggaagaagtaccaatcgatggatcttgtggtgaacatgcagttcgccgactggggcaacgccgtgggtcgtgtcgatgcttcaggccagacgctcacgttctccggcggcggaggcagctttgcgaagccctcggagggagacatcttctcgtgcgactccgggccgtttgcgcacggggcggacgtgtcggacaagcagttgaatgtcggggcgcggctggcggcggcgctgaacaggagtactttgctggacgcggtgccgcatccggagggggaggatgtgagcatgtattataaggaggctgtgacgaaccactatgcgaggatttgtcatgaggtgagtgttggggggagggggtacgcgtttccgtatgatgatgttggggcgacgggggggacggaccagagcgggtttttgaatgatggggatccaaaggtgttgacgattggggttggggggcctctttga

SEQ ID NO: 8 - protein, 380 aa, Trichoderma harzianum
MTPTTLSVVVKNNSNASQLYAYVTGRAAQGLFFLSADGTTPYFPTSPSSTLQPLAKDCAVAIGGPGRSRTLTVPRLDGARVWFSQESPLTFLVNPGPAVVEPSATNPADPNYNIRWAFAEFTLNEAELYVNVSYVDFFSVPVSLRLENGAGKVTSVDGMPAGALDEICGKLKAQAGVDKAGWDRLVVTQAGGSGQNLRALSPNSGRVMFQGLFDGYYRPYVDAVWKKYQSMDLVVNMQFADWGNAVGRVDASGQTLTFSGGGGSFAKPSEGDIFSCDSGPFAHGADVSDKQLNVGARLAAALNRSTLLDAVPHPEGEDVSMYYKEAVTNHYARICHEVSVGGRGYAFPYDDVGATGGTDQSGFLNDGDPKVLTIGVGGPL

SEQ ID NO: 9 - protein, 380 aa, Trichoderma harzianum; identical to SEQ ID NO: 8

SEQ ID NO: 10 - DNA, 1344 bp, Trichoderma harzianum
  sig_peptide (1)..(48)
  CDS (1)..(1344)
atgcggacactcactatccttactaccctcattggtgcagtagcagcggccccttctctcattccaagagtatcacccttttccattgccaagcctggaggtgttgacgacatcgttatcacggcaaacaacactctcaacggaacctatcatagttcaacaacagtctccaaaaatgtcatccagactcgagctcaggctggacacctgcccatccaactcgtcaacaacttctccggtagtcaggtcaatgcatacatttccggcctggacactgacaacagggtcgtttttgtcaggggtgacggcagtcttgtgtatcccagctctggaggctccagtgtccctgttgcgatcagcacccccatcaacattgcgttgcctgctcaaggccagtccatcacggtgaatgtgcctattgtcatcagctctgcgcgtatctacttttcagtgggcgatctccagttcttcatggtcaagattcccaacggcgatggcttggtgcaaccgtcccagttcaaccttcaagacccgagtgcaggcctcctctggggctttgttgagctcacctatactacggacctggctgtctacgcaaacatcagctacgtcgactttgtcggtatgattctcagtatgagcttgagtgccacggatggaagcgccactcagaccacgaaaggccttggatcttccgcactcacccagatttgccagggcttggtccaacaagctagcgtcgacggcttcccctggtcttcgatgtgtatcgccaattctgctggaactctcgttcgtgcgctgtctccaggcgactacagtgtgatcaatgcagcggccttccagaactactggagtgcctatgtcgaccaagtctggagccagtatactaacactcctctcaccatcaacacacaaacctctgctggcagcgtcaactgccaggtctccggcgacacgctgaactgcaacggcgacaaccgcggctacgctaagccggctgcaggagacatctggggctgcaacagtggaccatttgccattcagagcggtgacaatgccgtccattcggctgttgttccccgtctgtgtgctgcctttgtgcgatctaccttgttgcttgctggtggcaacgttcagccaggcctgggccagtcttcatactacacagtcagccctaccaaccactacagccgtcttgttcaccaatttgaaattgatggtcgaggctacgctttcccatatgatgatgtcaacccagatggtaatgagaatgcctcgggcactttggcttcaggggctcccaatgttctgactgtctacgtcggcgctcctccttcataa

SEQ ID NO: 11 - protein, 447 aa, Trichoderma harzianum
MRTLTILTTLIGAVAAAPSLIPRVSPFSIAKPGGVDDIVITANNTLNGTYHSSTTVSKNVIQTRAQAGHLPIQLVNNFSGSQVNAYISGLDTDNRVVFVRGDGSLVYPSSGGSSVPVAISTPINIALPAQGQSITVNVPIVISSARIYFSVGDLQFFMVKIPNGDGLVQPSQFNLQDPSAGLLWGFVELTYTTDLAVYANISYVDFVGMILSMSLSATDGSATQTTKGLGSSALTQICQGLVQQASVDGFPWSSMCIANSAGTLVRALSPGDYSVINAAAFQNYWSAYVDQVWSQYTNTPLTINTQTSAGSVNCQVSGDTLNCNGDNRGYAKPAAGDIWGCNSGPFAIQSGDNAVHSAVVPRLCAAFVRSTLLLAGGNVQPGLGQSSYYTVSPTNHYSRLVHQFEIDGRGYAFPYDDVNPDGNENASGTLASGAPNVLTVYVGAPPS

SEQ ID NO: 12 - protein, 431 aa, Trichoderma harzianum
APSLIPRVSPFSIAKPGGVDDIVITANNTLNGTYHSSTTVSKNVIQTRAQAGHLPIQLVNNFSGSQVNAYISGLDTDNRVVFVRGDGSLVYPSSGGSSVPVAISTPINIALPAQGQSITVNVPIVISSARIYFSVGDLQFFMVKIPNGDGLVQPSQFNLQDPSAGLLWGFVELTYTTDLAVYANISYVDFVGMILSMSLSATDGSATQTTKGLGSSALTQICQGLVQQASVDGFPWSSMCIANSAGTLVRALSPGDYSVINAAAFQNYWSAYVDQVWSQYTNTPLTINTQTSAGSVNCQVSGDTLNCNGDNRGYAKPAAGDIWGCNSGPFAIQSGDNAVHSAVVPRLCAAFVRSTLLLAGGNVQPGLGQSSYYTVSPTNHYSRLVHQFEIDGRGYAFPYDDVNPDGNENASGTLASGAPNVLTVYVGAPPS

SEQ ID NO: 13 - DNA, 1388 bp, Lecanicillium primulinum
  sig_peptide (1)..(48)
  CDS (1)..(1338)
atgaagttcctcaccgtggttgccgccctgttgggtgccgccatggccgctccgtctgttgacatccgcggtgacaatgacattaccattgttcaccctggtactgtgagtgacatgaaggttacaaaggacaacaccctcaatggcacatatcacagcccccagaccaagattgtggttcctcaggacctctccgagcgagccccgacctccattcccttccagtttgtcaacaactttgctggaaaggccgtcaacgcctacgttgtcggtctggacaaccagaagcgagtcgtatttgtccgccaggatggaacactcgtctatcccagctcgggaggctctggtgttccggtgcctatcagagacagcatcaagatttctcttcccggcaagggccagaagctctccatgacgctccccatccctctcgagtctggccgcatctacttcgccgagggcgagctacagttcgccatggtccgcaccggagacggtggtgacggcctcgtccagccctccgtgaccaacttgcaggaccccagtgccggtaccaactggggctttgtcgagctcaccttcaccaaggaaggcgccatctatgccaacatcagctacgttgactttgtcggcatgattctgagcatgcagctcactgtccgcgacggctccgccacgcagatcaccaagggcctcgcctcaggctctatgcctaccatctgcaacgaaatccgccagcagggctccagtgacggccgcccctggggccgcatgtgcatcgccgacggctccggcaaccccgtccgcgtcctctcccccaacgactacactgtgattgaccccaacggcttcgccaactactggaccgactacgtcaaccaggtctacgacaagtactccagagagcccctcgtcatcaacacccagggctctgccggcaacgtcaactgccgagtcagcaacaaccagctgctctgcgacggtgacaacctgcctttcgagaagcccgccgccgccgacatttggggctgcaacagcggtcccttccagaaccgtggcaacggcgtccacctcgcggccgtcgcgcgcctctgcgccgccttcacccgctccaccctcctcctcaacggcggtaacgtccagcccaagctctccggcagctcctactacaccgttaatcccacgagccactatagccgcctcatccacaagcacgaggtcgacggccgtggctacgccttctcctacgatgatgtcaaccccaacgaggagaacgcctcgggcactgtctcgaacggccagcccaacaccctcaccgtctacgtcggcggctactaaaagagcctgacgtaagctcctgtatatatcagaccgtcagtagagaagag

SEQ ID NO: 14 - protein, 445 aa, Lecanicillium primulinum
MKFLTVVAALLGAAMAAPSVDIRGDNDITIVHPGTVSDMKVTKDNTLNGTYHSPQTKIVVPQDLSERAPTSIPFQFVNNFAGKAVNAYVVGLDNQKRVVFVRQDGTLVYPSSGGSGVPVPIRDSIKISLPGKGQKLSMTLPIPLESGRIYFAEGELQFAMVRTGDGGDGLVQPSVTNLQDPSAGTNWGFVELTFTKEGAIYANISYVDFVGMILSMQLTVRDGSATQITKGLASGSMPTICNEIRQQGSSDGRPWGRMCIADGSGNPVRVLSPNDYTVIDPNGFANYWTDYVNQVYDKYSREPLVINTQGSAGNVNCRVSNNQLLCDGDNLPFEKPAAADIWGCNSGPFQNRGNGVHLAAVARLCAAFTRSTLLLNGGNVQPKLSGSSYYTVNPTSHYSRLIHKHEVDGRGYAFSYDDVNPNEENASGTVSNGQPNTLTVYVGGY

SEQ ID NO: 15 - protein, 429 aa, Lecanicillium primulinum
APSVDIRGDNDITIVHPGTVSDMKVTKDNTLNGTYHSPQTKIVVPQDLSERAPTSIPFQFVNNFAGKAVNAYVVGLDNQKRVVFVRQDGTLVYPSSGGSGVPVPIRDSIKISLPGKGQKLSMTLPIPLESGRIYFAEGELQFAMVRTGDGGDGLVQPSVTNLQDPSAGTNWGFVELTFTKEGAIYANISYVDFVGMILSMQLTVRDGSATQITKGLASGSMPTICNEIRQQGSSDGRPWGRMCIADGSGNPVRVLSPNDYTVIDPNGFANYWTDYVNQVYDKYSREPLVINTQGSAGNVNCRVSNNQLLCDGDNLPFEKPAAADIWGCNSGPFQNRGNGVHLAAVARLCAAFTRSTLLLNGGNVQPKLSGSSYYTVNPTSHYSRLIHKHEVDGRGYAFSYDDVNPNEENASGTVSNGQPNTLTVYVGGY

SEQ ID NO: 16 - DNA, 1329 bp, Simplicillum lamellicola
  sig_peptide (1)..(45)
  CDS (1)..(1329)
atgcgtttcgctctattggccgctcttgctggcttggcttctgccatgcccaagaacgacatcatcttcagccgaggcaacggtggtgctctgcaagcccagcctggccccgtatctaagatgatcgtcgataaggataccaccttgaacggtacgcacaagggccctactgtcgtagtccccccttccaagagcaagagcttggctgcccaagtcaaccttcccctctcctttgtcaacaacttcccgggcgctatcaacgcctacttggttggaaaatgccccaacggcgctgtttgcttcatccgtggcgatggtagcattgtctaccccagctctggtggctctgccactcctagacccattgacagcaacagtgtccgcattccagttgcccagggccaaactctcaacctgcgcgtgcctgttgccatcaactctgctagaatctactttgccgctggagatatgcatttcggcatggtcgccactcccaacggagatggtcttgtgcagcccgcaccccaaaaccctcaagatccttctgccagtgtcaactttggtttcatcgagttcaacattgaccccaacggtaccatcttcactaacgtctcgtatgtcgactttgtcggtctggttttgggcatgcagcttgaggataacaacggtcctactcagactgctcgtggtctccgtgcgggcagtgctggtgatgtctgcaacgacttgaaagcccagggtcagcgcgatggtcgtccttggggctcccactgtatgaccaacggcaatggtcaggtcgtccgtgttttgtctcccaacagctatgctgaggttgatcccaatggctttgccaactactgggatggctatatcaaccaagtctactccaagtactcgggccaggacttgactatgcgcaccaagtttggtgaccaccagtgccgcgccaacggcaacacaatgacttgcaacggcgacgagcgcccctacaacaagcccactgccaaggaactctggggatgcgacggcggtccctttgcgaacactggaagcgatttgcacaaggctcacttggccattctctgctctgccttccaccgcactactcttcttctcaatggtggcaacatccagcccaacctcccctcttccagctactacactgtttctcccagcaactactactccaagtctgttcacgctcacgagcttgacggcaagggttatgctttcccctatgacgatgttgatgcggctggcgagaaccagtctggaactctggctacctccaaccctcgttccctgttgatctggatcggcggtaactaa

SEQ ID NO: 17 - protein, 442 aa, Simplicillum lamellicola
MRFALLAALAGLASAMPKNDIIFSRGNGGALQAQPGPVSKMIVDKDTTLNGTHKGPTVVVPPSKSKSLAAQVNLPLSFVNNFPGAINAYLVGKCPNGAVCFIRGDGSIVYPSSGGSATPRPIDSNSVRIPVAQGQTLNLRVPVAINSARIYFAAGDMHFGMVATPNGDGLVQPAPQNPQDPSASVNFGFIEFNIDPNGTIFTNVSYVDFVGLVLGMQLEDNNGPTQTARGLRAGSAGDVCNDLKAQGQRDGRPWGSHCMTNGNGQVVRVLSPNSYAEVDPNGFANYWDGYINQVYSKYSGQDLTMRTKFGDHQCRANGNTMTCNGDERPYNKPTAKELWGCDGGPFANTGSDLHKAHLAILCSAFHRTTLLLNGGNIQPNLPSSSYYTVSPSNYYSKSVHAHELDGKGYAFPYDDVDAAGENQSGTLATSNPRSLLIWIGGN

SEQ ID NO: 18 - protein, 427 aa, Simplicillum lamellicola
MPKNDIIFSRGNGGALQAQPGPVSKMIVDKDTTLNGTHKGPTVVVPPSKSKSLAAQVNLPLSFVNNFPGAINAYLVGKCPNGAVCFIRGDGSIVYPSSGGSATPRPIDSNSVRIPVAQGQTLNLRVPVAINSARIYFAAGDMHFGMVATPNGDGLVQPAPQNPQDPSASVNFGFIEFNIDPNGTIFTNVSYVDFVGLVLGMQLEDNNGPTQTARGLRAGSAGDVCNDLKAQGQRDGRPWGSHCMTNGNGQVVRVLSPNSYAEVDPNGFANYWDGYINQVYSKYSGQDLTMRTKFGDHQCRANGNTMTCNGDERPYNKPTAKELWGCDGGPFANTGSDLHKAHLAILCSAFHRTTLLLNGGNIQPNLPSSSYYTVSPSNYYSKSVHAHELDGKGYAFPYDDVDAAGENQSGTLATSNPRSLLIWIGGN

SEQ ID NO: 19 - DNA, 910 bp, Simplicillium lamellicola
  sig_peptide (1)..(57)
  exon (1)..(771)
  Intron (772)..(829)
  exon (830)..(910)
atggttgcttaccgtcttgtcacttccctcctttccctcgccgccgtcggctctgcttgggatgctcctcaatacggtggcttcaaccgtgtctggcaggacaactttgctggcaacggcggcacctctcccaacggcaacaactggaacatcatcaccggtaacttgggcgtcaacgctgagctcgagtactacactgccagcacccacaaccttcagctgagcggcggcaacaccctgcagattgttccatggagagagaacggcggttggacctctggccgtattgagtccaagtacaccatcactcctcaggagggccgcttgactcgtatggaggctcagatccgtttcggtaccaacgaccctagccacaagcagggtatctggcccgctttctggatgttgggtgactctatccgtcacggaacccaatggcctggctgtggtgagctcgatattctcgagaccgtcaacggccagctcatcggtcacggtaccgttcactgcgacgtctaccccggtggtatctgtaacgagggtaacggaattggcaacggcgtcaacttccccaaccaagactggcagaactggcgtatcgaggtcgaccgccgtcccggtaactggctggaccagagcatcgtctggtacctcaatggtaacgagtaccaccgtgtcaacggtaaccgcatcaacaactacaacgtttggagatctcttgctcagagcccttacttcttcatcctcaacgttgctgttggtggcaactgggtaagtcaacaacttccgctcctcccaatttcacacatcaatactaacctcttcttagcccggtaaccctgatggcaacactcaagatggctacggcagcatgatggaggtcggttacgtcgccgcctactctacctaa

SEQ ID NO: 20 - protein, 283 aa, Simplicillum lamellicola
MVAYRLVTSLLSLAAVGSAWDAPQYGGFNRVWQDNFAGNGGTSPNGNNWNIITGNLGVNAELEYYTASTHNLQLSGGNTLQIVPWRENGGWTSGRIESKYTITPQEGRLTRMEAQIRFGTNDPSHKQGIWPAFWMLGDSIRHGTQWPGCGELDILETVNGQLIGHGTVHCDVYPGGICNEGNGIGNGVNFPNQDWQNWRIEVDRRPGNWLDQSIVWYLNGNEYHRVNGNRINNYNVWRSLAQSPYFFILNVAVGGNWPGNPDGNTQDGYGSMMEVGYVAAYST

SEQ ID NO: 21 - protein, 264 aa, Simplicillium lamellicola
WDAPQYGGFNRVWQDNFAGNGGTSPNGNNWNIITGNLGVNAELEYYTASTHNLQLSGGNTLQIVPWRENGGWTSGRIESKYTITPQEGRLTRMEAQIRFGTNDPSHKQGIWPAFWMLGDSIRHGTQWPGCGELDILETVNGQLIGHGTVHCDVYPGGICNEGNGIGNGVNFPNQDWQNWRIEVDRRPGNWLDQSIVWYLNGNEYHRVNGNRINNYNVWRSLAQSPYFFILNVAVGGNWPGNPDGNTQDGYGSMMEVGYVAAYST

SEQ ID NO: 22 - DNA, 864 bp, Trichoderma reesei
  sig_peptide (1)..(57)
  CDS (1)..(864)
atgtggtctcccaaggttgccgccgccatcctcgcctttgttggcctctccaacgcctgggcacctccgtcctatggcggcttcaacctggtctggaacgacgccttcgcgggcaacggcggcacgtctcccaacacaggcaactggaacatcatcaccggcaacctcaacgtcaacaacgagctcgagacgtactcgtccagcaccaagaacgtgcagctgagcggtggcaacaccctgcagctggtgccctggaaggacagcagcacctttggcggctggacctctggccgcctcgagtccaagtacaccttcaccccccaggccggcaaggtgacccgcgccgaggcctccatccgcatgggcagcaacgcccaggccaacaagcagggcatctggcccgccttctggatgctgggcgacgtgctgcgtcacggcggcagctggcccagctgcggcgagatcgacatcctcgagcaggtcaacggccagcccacgggccacggcaccctccactgcgacgtctaccccggcggcatctgcaacgagggcaacggcattggcggccccgtcaacttcaacaaccccaacgacttccacacctggcgcgtcgagattgaccgcacgtccaacaactggcagaccgagaccctgacttggtccctcgacggcaccaacttcttccagatcactggttcccgcatcggcaaccagaacgtctggaacaacattgcccacagccccctgttcttcatcctcaacgttgctgttggtggcagctggcccggcaaccccaacagcgctaccctcgatggctatggcgccatgatggaggttggctacgttgcccagtactctacctaa

SEQ ID NO: 23 - protein, 287 aa, Trichoderma reesei
MWSPKVAAAILAFVGLSNAWAPPSYGGFNLVWNDAFAGNGGTSPNTGNWNIITGNLNVNNELETYSSSTKNVQLSGGNTLQLVPWKDSSTFGGWTSGRLESKYTFTPQAGKVTRAEASIRMGSNAQANKQGIWPAFWMLGDVLRHGGSWPSCGEIDILEQVNGQPTGHGTLHCDVYPGGICNEGNGIGGPVNFNNPNDFHTWRVEIDRTSNNWQTETLTWSLDGTNFFQITGSRIGNQNVWNNIAHSPLFFILNVAVGGSWPGNPNSATLDGYGAMMEVGYVAQYST

SEQ ID NO: 24 - protein, 268 aa, Trichoderma reesei
WAPPSYGGFNLVWNDAFAGNGGTSPNTGNWNIITGNLNVNNELETYSSSTKNVQLSGGNTLQLVPWKDSSTFGGWTSGRLESKYTFTPQAGKVTRAEASIRMGSNAQANKQGIWPAFWMLGDVLRHGGSWPSCGEIDILEQVNGQPTGHGTLHCDVYPGGICNEGNGIGGPVNFNNPNDFHTWRVEIDRTSNNWQTETLTWSLDGTNFFQITGSRIGNQNVWNNIAHSPLFFILNVAVGGSWPGNPNSATLDGYGAMMEVGYVAQYST

SEQ ID NO: 25 - DNA, 919 bp, Trichoderma atroviride
  sig_peptide (1)..(57)
  exon (1)..(777)
  Intron (778)..(838)
  exon (839)..(919)
atgtggtcccctaagattgctgccgctgttctcgcctttgttggagcttccaacgcttgggctcctccctcatactccggttacaaccttgtttggtccgactccttcgccggcaatggcggtacttctcccaacactggcaactggaacatcatcaccggttacctgaacgtcaacggcgagcaggagacctactcctccagcacccagaatgttcagctcagtggtggaaacactctccagattgtcccctggaacaacggcggcagctggacctctggccgtctcgagtctacctacaccttcacccctgctgctggcagggtgaccgctgtcgaggcttccattcgcttcggtaccaacgctccggccaaccagcagggcatgtggcctgctttctggatgctgggtaactccatccgtaccggtggcggctggccttcttgcggtgagatcgacatcatggaggtggtcaatgaccagtctacgggccacggaaccatccactgcgatgtctaccccggcggtatctgcaacgagggtaatggtatcggaggcagcactggcatcaacggcggcaacaccaacttccacacctggcgtgtccagatcgatcgtacgcccagcagctggcaatccgagaccatcaccttcttcctcgacggtgctcagtacttccaggtcgctggttcccgcatcaacaaccagaatgtctggaacagccttgcccacagccctctgttcatcattctcaacgtcgctgttggcggcagtttcgtatgtatctccttctttgcccgttgggcttccactatgcaaattactaacatgacaacagcccggaaacaccaacggcaacaccctgggtggctacggcagcatgatggaggttggctacgtcgcccagtactccacttaa

SEQ ID NO: 26 - protein, 285 aa, Trichoderma atroviride
MWSPKIAAAVLAFVGASNAWAPPSYSGYNLVWSDSFAGNGGTSPNTGNWNIITGYLNVNGEQETYSSSTQNVQLSGGNTLQIVPWNNGGSWTSGRLESTYTFTPAAGRVTAVEASIRFGTNAPANQQGMWPAFWMLGNSIRTGGGWPSCGEIDIMEVVNDQSTGHGTIHCDVYPGGICNEGNGIGGSTGINGGNTNFHTWRVQIDRTPSSWQSETITFFLDGAQYFQVAGSRINNQNVWNSLAHSPLFIILNVAVGGSFPGNTNGNTLGGYGSMMEVGYVAQYST

SEQ ID NO: 27 - protein, 266 aa, Trichoderma atroviride
WAPPSYSGYNLVWSDSFAGNGGTSPNTGNWNIITGYLNVNGEQETYSSSTQNVQLSGGNTLQIVPWNNGGSWTSGRLESTYTFTPAAGRVTAVEASIRFGTNAPANQQGMWPAFWMLGNSIRTGGGWPSCGEIDIMEVVNDQSTGHGTIHCDVYPGGICNEGNGIGGSTGINGGNTNFHTWRVQIDRTPSSWQSETITFFLDGAQYFQVAGSRINNQNVWNSLAHSPLFIILNVAVGGSFPGNTNGNTLGGYGSMMEVGYVAQYST

SEQ ID NO: 28 - DNA, 1071 bp, Aspergillus nidulans
  sig_peptide (1)..(57)
  CDS (1)..(1071)
atggtcagcttcaccagcctgctggcgggcgtcgccgccatcagcggcgtcctggccgcccccgccgccgaggtcgagagcgtcgccgtcgagaagcgggcctacgtcctccaggacgactacagccccgatgtcttcttcgacaagttcaccttcttcaccgacgccgaccccacccacggccacgttgactacgtggaccgaggcaccgcccagagcgcgggcctcatcagcagcggcagcagcgtctacatgggcgtggaccacaccaacatcgccagctcgggccgccagagcgtccgcctgagcagcacccagacctaccaccacggcctgttcatcatcgacctgagccacatgcccaccggctgcggcacctggcccgccttctggattctcggccccgactggcccaacggcggcgagattgatgtcatcgagaacgtcaacgtcgccaccaacaaccacatgaccctgcacaccagcgacggctgcaccatcgacagcagcggcttcaccggcaccctgctgaccagcaactgcttcgtcaacgcccccggccaggccaacaacgcgggctgcggcatccagagccccgacagcaacagctacggcgcgggcttcaacagcaacagcggcggcgtctacgccaccgagtggaccagcgaccacatcagcatctggttcttcccccgcagcagcatcccgagcgacatcacggcgggcaaccccgacccgagcacctggggcacccccgccgcccgcttcgcgggcaactgcgacatcgagagccacttcaccgacatgcagatcatcttcgacatcaccttctgcggcgactgggcgggcaacgtctgggagagcagcacctgcgccagcctgggctcctgcaccgactacgtcagcaacaaccccgaggcgttcgccgacgcctactgggacatcaacagcctgcgcgtctaccaggacagcgccgccgccaagcgcgacgagatcgagggccgcgagaagaccagcgccaagggcttcccccgcaagagcatgagggcgaggcgcgacgcgggcctgtga

SEQ ID NO: 29 - protein, 356 aa, Aspergillus nidulans
MVSFTSLLAGVAAISGVLAAPAAEVESVAVEKRAYVLQDDYSPDVFFDKFTFFTDADPTHGHVDYVDRGTAQSAGLISSGSSVYMGVDHTNIASSGRQSVRLSSTQTYHHGLFIIDLSHMPTGCGTWPAFWILGPDWPNGGEIDVIENVNVATNNHMTLHTSDGCTIDSSGFTGTLLTSNCFVNAPGQANNAGCGIQSPDSNSYGAGFNSNSGGVYATEWTSDHISIWFFPRSSIPSDITAGNPDPSTWGTPAARFAGNCDIESHFTDMQIIFDITFCGDWAGNVWESSTCASLGSCTDYVSNNPEAFADAYWDINSLRVYQDSAAAKRDEIEGREKTSAKGFPRKSMRARRDAGL

SEQ ID NO: 30 - protein, 337 aa, Aspergillus nidulans
APAAEVESVAVEKRAYVLQDDYSPDVFFDKFTFFTDADPTHGHVDYVDRGTAQSAGLISSGSSVYMGVDHTNIASSGRQSVRLSSTQTYHHGLFIIDLSHMPTGCGTWPAFWILGPDWPNGGEIDVIENVNVATNNHMTLHTSDGCTIDSSGFTGTLLTSNCFVNAPGQANNAGCGIQSPDSNSYGAGFNSNSGGVYATEWTSDHISIWFFPRSSIPSDITAGNPDPSTWGTPAARFAGNCDIESHFTDMQIIFDITFCGDWAGNVWESSTCASLGSCTDYVSNNPEAFADAYWDINSLRVYQDSAAAKRDEIEGREKTSAKGFPRKSMRARRDAGL

SEQ ID NO: 31 - DNA, 1535 bp, Trichoderma harzianum
  sig_peptide (1)..(54)
  exon (1)..(868)
  Intron (869)..(930)
  exon (931)..(1535)
atgcgttacgctctcatcgcctccatgcttggccaagccgccatcagcgttgctatgccttcggagcccgctcacagccctcgtgctgccggtgcccaggcctacgcatccaaccaggctggtaactacaagctcacctccattgctgctcccgttcaaggcaatggaagccctggctcatctacttggaacctgtccatcgacgacaccagcagtggctacaagcagaagatcgtcggtttcggtgctgccgtgactgatgccaccgtcgctgccttcaacgagctgtctgccagcacccttagccagctgctcgacgagctcatgactggtgctggtgccagcttctctctcatgcgccacaccatcggcgcctctgacttgtctgccgacccagcctacacttatgacgacaacggaggcaatgctgaccccaatatgactggcttcaacctcggagaccgtggtactgccatggccaccatgctggctcagatgaagggcctcaactccaacctccagatctttggatctccctggagtgctcctggatggatgaagctgaacaacgccattgacggcaacaccaacaacaacaacctgaacgatggttacctcaccaacaacggtgctcagtactcggctgcttttgcccagtactttgtcaagtacatccaggcattcgagtcgcacggcgccaccatcaatgccattaccctccagaacgagcccctgaacagccaggctggctatcccaccatgtacatgttctcgtacgagcagggagacctgatccagaactacgtcgcccctgccttgaaggcggccggtctgagcaccaagatctgggcttacgaccacaacactggtatgtttcgatcctcattacttacagaccgtgattcatatagctgacataactgttcgcagaccaacctgatttccccgagcaggtcatgggcatcgccgcagacgatgtctctgccgttgcatggcactgctatgcctcgaccctggactggactgtcctgaccaacttccacaactcctaccccaacactgaccagtacatgactgagtgctggaccccctccactggtgcttggaaccaggccgccgacttcaccatgggccctctccagaactgggcccgtggtgttgctgcatggacccttggcaccactgcccaggacggccctcacctgtccagcggtggctgcggcacttgcactggtctcgtcaccatcaacaacggcgcatacaccttccagactgcttactacatgatggcccagttctccaagttcatgcccgttggagccaccgtcctgagcggcaccggcagctacacttactccggcagcggcggtgttcagtccgttgcttctctcaaccccgatggcacccgcacggtcgtcatcgagaacactttcggcaacgacatttacatccacctgaccacctccagtggccaggagtggagcggcaacgtccctaccaactctgtcaccacctgggtcctccccgctgtttaa

SEQ ID NO: 32 - protein, 490 aa, Trichoderma harzianum
MRYALIASMLGQAAISVAMPSEPAHSPRAAGAQAYASNQAGNYKLTSIAAPVQGNGSPGSSTWNLSIDDTSSGYKQKIVGFGAAVTDATVAAFNELSASTLSQLLDELMTGAGASFSLMRHTIGASDLSADPAYTYDDNGGNADPNMTGFNLGDRGTAMATMLAQMKGLNSNLQIFGSPWSAPGWMKLNNAIDGNTNNNNLNDGYLTNNGAQYSAAFAQYFVKYIQAFESHGATINAITLQNEPLNSQAGYPTMYMFSYEQGDLIQNYVAPALKAAGLSTKIWAYDHNTDQPDFPEQVMGIAADDVSAVAWHCYASTLDWTVLTNFHNSYPNTDQYMTECWTPSTGAWNQAADFTMGPLQNWARGVAAWTLGTTAQDGPHLSSGGCGTCTGLVTINNGAYTFQTAYYMMAQFSKFMPVGATVLSGTGSYTYSGSGGVQSVASLNPDGTRTVVIENTFGNDIYIHLTTSSGQEWSGNVPTNSVTTWVLPAV

SEQ ID NO: 33 - protein, 490 aa, Trichoderma harzianum; identical to SEQ ID NO: 32

SEQ ID NO: 34 - DNA, 1290 bp, Simplicillium lamellicola
  sig_peptide (1)..(51)
  CDS (1)..(1290)
atgaagtactctctcgttgctccagctctgctggccacagctgtccaggcctggctcccccaggaccgcgaccttgccgcgttcaaccagactgcccgtcacgagcagcttggcaagcgcttcaagccaactctgcccaacggcgtgaccaagatccgcggcgtcaactttggtggctggttggtgtgcgagccctggatgatgcaaaacgagtggcgcaacaacatgggctgcggcgacagcgcgtccgagtttgactgcatgaaggaccactacagcggcggcaaccgcgacgccggtaaccaaaagtttgagaaccactggagagattggatcaacgccgataccgtccagtcagtgcacgacgtcggtctcaacaccatccgtatccccattggctactggtcttacaccgatattgtcgacaagaacagcgagccctttgctgacggtaaccgcatgttgccctacctcgatgctgttgtgcgcaaggctgccgaccttggcatctatgtcatcatggaccttcacggtgcccctggcggccagcaggaggacgtcttcaccggccagaacaaccgccctgccggcttctacaacgactacaactttggccgtgccgagaagtggttggcctggatgaccaaccgcatccacaccaacgacgcctaccgcaccgtcggtatgattgaggttctcaacgagcccgtctcccgccacgacgccggcaaccgttaccctgcccctggccaggaccctggcctggtccagaactactaccccaacgccctcaaggccgttcgcgatgccgagtccaagctcaacgtcggcgatgacaagaagctccatgtccagttcatgagctccaagtgggactctggtgatgcccgctccgttgctgctatccgcaacgaccccatgactgctttcgacgaccacaactacattggcttcgccctcggcggaagcggtgaccaaaactcgctcatgcgcagcgcctgtaccgactctcgcgttgttcagggccaggactttgaattcaccggcgaatggagcatgacttctggcgctgactggcacgacgccgacttcttcaaaaagttcttcactgcccagcaacagctctacgagaagcccggcatggacggctgggtctactggacctggaagactgagctcaacgaccctcgctggacttactctcacgccacttcgctcaactatgtccctactgatgctgctgccctcgagaagaacgtctaccaggatgtctgcgctggcttcagataa

SEQ ID NO: 35 - protein, 429 aa, Simplicillium lamellicola
MKYSLVAPALLATAVQAWLPQDRDLAAFNQTARHEQLGKRFKPTLPNGVTKIRGVNFGGWLVCEPWMMQNEWRNNMGCGDSASEFDCMKDHYSGGNRDAGNQKFENHWRDWINADTVQSVHDVGLNTIRIPIGYWSYTDIVDKNSEPFADGNRMLPYLDAVVRKAADLGIYVIMDLHGAPGGQQEDVFTGQNNRPAGFYNDYNFGRAEKWLAWMTNRIHTNDAYRTVGMIEVLNEPVSRHDAGNRYPAPGQDPGLVQNYYPNALKAVRDAESKLNVGDDKKLHVQFMSSKWDSGDARSVAAIRNDPMTAFDDHNYIGFALGGSGDQNSLMRSACTDSRVVQGQDFEFTGEWSMTSGADWHDADFFKKFFTAQQQLYEKPGMDGWVYWTWKTELNDPRWTYSHATSLNYVPTDAAALEKNVYQDVCAGFR

SEQ ID NO: 36 - protein, 412 aa, Simplicillium lamellicola
WLPQDRDLAAFNQTARHEQLGKRFKPTLPNGVTKIRGVNFGGWLVCEPWMMQNEWRNNMGCGDSASEFDCMKDHYSGGNRDAGNQKFENHWRDWINADTVQSVHDVGLNTIRIPIGYWSYTDIVDKNSEPFADGNRMLPYLDAVVRKAADLGIYVIMDLHGAPGGQQEDVFTGQNNRPAGFYNDYNFGRAEKWLAWMTNRIHTNDAYRTVGMIEVLNEPVSRHDAGNRYPAPGQDPGLVQNYYPNALKAVRDAESKLNVGDDKKLHVQFMSSKWDSGDARSVAAIRNDPMTAFDDHNYIGFALGGSGDQNSLMRSACTDSRVVQGQDFEFTGEWSMTSGADWHDADFFKKFFTAQQQLYEKPGMDGWVYWTWKTELNDPRWTYSHATSLNYVPTDAAALEKNVYQDVCAGFR

SEQ ID NO: 37 - DNA, 1429 bp, Trichoderma atroviride
  sig_peptide (1)..(48)
  exon (1)..(73)
  Intron (74)..(131)
  exon (132)..(583)
  Intron (584)..(644)
  exon (645)..(914)
  Intron (915)..(997)
  exon (998)..(1429)
atgttgtctgcatatgccttttcgctgctagtagcttcagccagcgcctggactcctcagtccaacgcaaagggtcagtaaaggctcaaatcacagatggtctattggacaacagcttacgaatgacacagtcttcagccgagataccgaaggcgtcatgagatggctacccggcaacgacaagttccgcggtgtcaacctcggctcgcagttcatcattgaaccatggatggcttctgatgagttctcaggcatgggctgtggcggactcaacgacgaatggtcttgcgtccaaagcctcggccaggatgctgctgacgccgccttccagaagcactgggacagctggatcactcaagacgacatcacccagatcaagaatctgggactcaacacagtccgtatcccagttggcttctggatccgcgaagaccttgttcaacaaggcgaattcttccctcgaggaggtattcagtacctggaccgtctagtcggatggtgcaatgacgcaggcatctatgtcattatggatcttcacggcggccctggagcgcagttccctaaccagcaatacactggccatgtaagagaagcagtccgatgccttgaattcttcaagttctcgactaatagtatatcaatagggagtctcacagcctgggttctacaccgaggcaaactacgaacgagcagccaacttcctagagtggatgactgagcgcattcacaccaacgccacctatgcatccgtcggcatgctagaagtcatcaatgagcccgtccactctggtgatttccccagccaagctgctgacatggtcaacacttactatcctctcgcctggaaccgcatccgtgatactgaaagcaaactgggcgtctctgacgataagcgccttcatatccaattcatggttcgtcctcctccctagctatcaaatgcctttgatcaacagcctttgatcaacaagacaagctaacaaactcgcaataacaggcctcggcctggggctccggagacccaaccagcgccctccccagcaccgacttcgccgccttcgacgaccaccgctacctcaaatgggacaccagcgtcaccgccactaaagacggctatctcaacgccgcctgcagcgacaagcgcgacgacaacgtcatcgtcggcgagtggtccatctccgtcgccgacaacgtccaggacaacgacgagctcggcatcaagaaccgctccgaccaggccgactggtaccagaagttctgggccgcccaggtgctcgcctttgagaagtcggccggctgggtcttttggacgtggaagtgcaactggatcacgggatatgatgactggaggtggtgctatcagtctgctgttgcggcgggtgcgattcccaaggacgcaggcagcgcggctagcattaacccgtgttaa

SEQ ID NO: 38 - protein, 408 aa, Trichoderma atroviride
MLSAYAFSLLVASASAWTPQSNAKVFSRDTEGVMRWLPGNDKFRGVNLGSQFIIEPWMASDEFSGMGCGGLNDEWSCVQSLGQDAADAAFQKHWDSWITQDDITQIKNLGLNTVRIPVGFWIREDLVQQGEFFPRGGIQYLDRLVGWCNDAGIYVIMDLHGGPGAQFPNQQYTGHGVSQPGFYTEANYERAANFLEWMTERIHTNATYASVGMLEVINEPVHSGDFPSQAADMVNTYYPLAWNRIRDTESKLGVSDDKRLHIQFMASAWGSGDPTSALPSTDFAAFDDHRYLKWDTSVTATKDGYLNAACSDKRDDNVIVGEWSISVADNVQDNDELGIKNRSDQADWYQKFWAAQVLAFEKSAGWVFWTWKCNWITGYDDWRWCYQSAVAAGAIPKDAGSAASINPC

SEQ ID NO: 39 - protein, 392 aa, Trichoderma atroviride
WTPQSNAKVFSRDTEGVMRWLPGNDKFRGVNLGSQFIIEPWMASDEFSGMGCGGLNDEWSCVQSLGQDAADAAFQKHWDSWITQDDITQIKNLGLNTVRIPVGFWIREDLVQQGEFFPRGGIQYLDRLVGWCNDAGIYVIMDLHGGPGAQFPNQQYTGHGVSQPGFYTEANYERAANFLEWMTERIHTNATYASVGMLEVINEPVHSGDFPSQAADMVNTYYPLAWNRIRDTESKLGVSDDKRLHIQFMASAWGSGDPTSALPSTDFAAFDDHRYLKWDTSVTATKDGYLNAACSDKRDDNVIVGEWSISVADNVQDNDELGIKNRSDQADWYQKFWAAQVLAFEKSAGWVFWTWKCNWITGYDDWRWCYQSAVAAGAIPKDAGSAASINPC

SEQ ID NO: 40 - DNA, 1348 bp, Trichoderma atroviride
  sig_peptide (1)..(51)
  exon (1)..(175)
  Intron (176)..(233)
  exon (234)..(1348)
atgcgatactcctttgttgccccggctcttctcgccggcactgcctacgcctggcttcctcaggagcgagatctggcggccttcaaccagacggctcgctttgaacagcttggcaagcggtttgagcctacgttggcttctggtgtcacaaagatcagaggtgtcaactttggtggtaagttcgcgtccgagcaattcctcaaatgagataggccacttacatggtgttctaggctggcttatctgtgagccatggatgatgcccaccgagtggaacagtgtgatgggctgcaacaacgctgcatccgagtttgactgcatgctcaacaactacatgggcaacaaccgtgcagcgggcaacgcaaagttcaagactcactggagcagctggatcactcccgctaccgttcagtcggttcacgatgtcggcctcaacaccatccgaatccccattggctactggtcctacacagccattgtcgacaccgccagcgagccgtttgccgatggtgatgccatgctcccatacctcgacgcggtcgtccagaaggctgctgatttgggaatctatgtcatcattgatcttcacggcgcccccggtggccagcagcaagacgccttcaccggccagaaccccaacccggctggcttcttcaactcatacgactttggccgtgccgagaagtggttgacatggatgaccaaccgcatccacaccaacccggcctactctaccgtcggtatgattgaggttctcaacgagcctgtttccaaccacgatgccaacggccgctaccctgccccgggtgaaaacccaggcttgacgcagacttactaccctgccgcactcaaggctgtccgcgatgccgagtctgccttgaacgttgccagcaacaagaagctgcacgttcagttcatgtccagcaaatggggctctggcgaccctcgctccaactctgctgtggccaacgaccccatgactggattcgacgaccacaactacattggctttgccgtcagcaacaacggcgaccagtactcgctcatgcacagcgcctgcaccgacactcgcgttgtcagcggccagaactttgagatcaccggcgaatggagcatgacatcaggcgttgattggcacgatcaagccttcttcacaaagttctggactgcccagcaacagctttacgagtcccccggaatggacggatggatctactggacttggaagactgagctgaacgacccccgatggacctactcctatgctacctacctcaactacatccctaccaacgctgctgccttggaacagaatgtttaccaggatgtctgcaacggattcaggtaa

SEQ ID NO: 41 - protein, 429 aa, Trichoderma atroviride
MRYSFVAPALLAGTAYAWLPQERDLAAFNQTARFEQLGKRFEPTLASGVTKIRGVNFGGWLICEPWMMPTEWNSVMGCNNAASEFDCMLNNYMGNNRAAGNAKFKTHWSSWITPATVQSVHDVGLNTIRIPIGYWSYTAIVDTASEPFADGDAMLPYLDAVVQKAADLGIYVIIDLHGAPGGQQQDAFTGQNPNPAGFFNSYDFGRAEKWLTWMTNRIHTNPAYSTVGMIEVLNEPVSNHDANGRYPAPGENPGLTQTYYPAALKAVRDAESALNVASNKKLHVQFMSSKWGSGDPRSNSAVANDPMTGFDDHNYIGFAVSNNGDQYSLMHSACTDTRVVSGQNFEITGEWSMTSGVDWHDQAFFTKFWTAQQQLYESPGMDGWIYWTWKTELNDPRWTYSYATYLNYIPTNAAALEQNVYQDVCNGFR

SEQ ID NO: 42 - protein, 412 aa, Trichoderma atroviride
WLPQERDLAAFNQTARFEQLGKRFEPTLASGVTKIRGVNFGGWLICEPWMMPTEWNSVMGCNNAASEFDCMLNNYMGNNRAAGNAKFKTHWSSWITPATVQSVHDVGLNTIRIPIGYWSYTAIVDTASEPFADGDAMLPYLDAVVQKAADLGIYVIIDLHGAPGGQQQDAFTGQNPNPAGFFNSYDFGRAEKWLTWMTNRIHTNPAYSTVGMIEVLNEPVSNHDANGRYPAPGENPGLTQTYYPAALKAVRDAESALNVASNKKLHVQFMSSKWGSGDPRSNSAVANDPMTGFDDHNYIGFAVSNNGDQYSLMHSACTDTRVVSGQNFEITGEWSMTSGVDWHDQAFFTKFWTAQQQLYESPGMDGWIYWTWKTELNDPRWTYSYATYLNYIPTNAAALEQNVYQDVCNGFR

SEQ ID NO: 43 - DNA, 1181 bp, Cornyascus sepedonium
  sig_peptide (1)..(54)
  exon (1)..(145)
  Intron (146)..(212)
  exon (213)..(851)
  Intron (852)..(921)
  exon (922)..(1181)
atgaagttctcggtcctctccagcatcctcgccaatgcgctgtctgtctcggcaggcaccatcctctgggatggtcgcttcaacgaccttagttcctcaactgacctggagaagtggtcgtgggggaaccaggtcggtccctaccgtaggtcgaatacgtccctctcgctccttcgtataccagcgagcaaatcaaagctgacagtccttagagtggtacatccacggttcgtcctcagtgacggcctacgtcaacctgtcgcctgactacaagaaccccgccgattcgggctccaagcagggcgccaagatcacgctggacaacacagcgtattggaacggccagaacatgcgccgcaccgagctcattccccagacaagcgctgccatcaaccagggcaaagtgtactaccacttctcgctgatgcgcaaggataccaacgcccctgccaccacgcgcgagcaccagatcgctttcttcgagagccactttactgagctcaaggccggcctgttgtcgggcgcccctggcgtatccgactcgctgctgcgctggtgcgtcggcggcgacaccaagtggagcacagagtgggaggccggtgtgtggcacaacgtcgcctacgagatcgacttcagcgccaacacggtcggcttctggcactcgaccggcagcgaccccctgacccggaagattgcccccatcagcgcaagcaccagcagcaacggcgccgactggcacgtcggcgtgctcgagctcccccgctcgggctactccgactctgacgaagactactactggtctggtgtttacattgagagtggcgacattacaactaacgtcgctggacccggtatgtttggtggtattaagtctgtacgtaccaagtaacccagttgctgacagctagatcgcatcaccaggcgctccttcgggcggcaacggcagtaccaccaccagcacgaccgtggcagttccctcgacgacgcttggtacctcgaccactaaggcctcgtctacaaccaccactcccggcccggccacttcgaccactgcaggctctggcggttgcactgcatctcaatggtcacagtgtgggggcataaattttacgggttgcacgacgtgcgcgtcgccgtacaagtgcaattttctcaacgactactattcgcaatgcgtttga

SEQ ID NO: 44 - protein, 347 aa, Cornyascus sepedonium
MKFSVLSSILANALSVSAGTILWDGRFNDLSSSTDLEKWSWGNQVGPYQWYIHGSSSVTAYVNLSPDYKNPADSGSKQGAKITLDNTAYWNGQNMRRTELIPQTSAAINQGKVYYHFSLMRKDTNAPATTREHQIAFFESHFTELKAGLLSGAPGVSDSLLRWCVGGDTKWSTEWEAGVWHNVAYEIDFSANTVGFWHSTGSDPLTRKIAPISASTSSNGADWHVGVLELPRSGYSDSDEDYYWSGVYIESGDITTNVAGPGAPSGGNGSTTTSTTVAVPSTTLGTSTTKASSTTTTPGPATSTTAGSGGCTASQWSQCGGINFTGCTTCASPYKCNFLNDYYSQCV

SEQ ID NO: 45 - protein, 329 aa, Cornyascus sepedonium
GTILWDGRFNDLSSSTDLEKWSWGNQVGPYQWYIHGSSSVTAYVNLSPDYKNPADSGSKQGAKITLDNTAYWNGQNMRRTELIPQTSAAINQGKVYYHFSLMRKDTNAPATTREHQIAFFESHFTELKAGLLSGAPGVSDSLLRWCVGGDTKWSTEWEAGVWHNVAYEIDFSANTVGFWHSTGSDPLTRKIAPISASTSSNGADWHVGVLELPRSGYSDSDEDYYWSGVYIESGDITTNVAGPGAPSGGNGSTTTSTTVAVPSTTLGTSTTKASSTTTTPGPATSTTAGSGGCTASQWSQCGGINFTGCTTCASPYKCNFLNDYYSQCV

SEQ ID NO: 46 - DNA, 915 bp, Aspergillus wentii
  sig_peptide (1)..(48)
  exon (1)..(109)
  Intron (110)..(160)
  exon (161)..(297)
  Intron (298)..(342)
  exon (343)..(507)
  Intron (508)..(555)
  exon (556)..(915)
atgaagcatctcaattacctcctctccctcccagccctcgtccactgcggcgacgtcgtctggaatggttttttcaactcttccataaccgttgaccattttgaccagtgtatgcccttacccccgtattactatatataaatatacactaataagatagggtcatggtccaaccaactcgaacccttccagtggtacattcacgggtccggcgcaacaagtcgctatctcggtctggcgccaatgaacaagaatcccgctgatgagagcgatgcgcaggggattcgcatcaccatcgtacgtctgccaatgaaataatacttatatatactaatagtgcaggacgacacctcctcatggaacggccagcaaatgatgcgttccgaactcattccccagacgagtgaggatctcggcagcggccatttattctatcacttttcgctcaagacgaataagaagaatgccccgaatccgaagtttgagcatcaaattgccttctttgaggtaccgtccctttatcttgatataatatgtggatgttaatgaaagtagagccacttcaccgaactccaatacggccaatccggaggcagcgacaacacgctgaaatggaacgcagatgggcaaacgcactggtcgacaacgctgcagccgcgacagtggtataactttgcgtatgagattgatttcgacgcaaagacggttggactgtgggcgtcgaatgggacggaggcattaacccaggtggtcaagggggtgagtgcgtcgacctcgaccaattctgccgattggcatgttggacagttgagactggataacggggataaaggaggaaaggaggattggttctggtcgggggtttatgtggaaaaggggccggttacgacgagtgttaaagggccttcttcttag

SEQ ID NO: 47 - protein, 256 aa, Aspergillus wentii
MKHLNYLLSLPALVHCGDVVWNGFFNSSITVDHFDQWSWSNQLEPFQWYIHGSGATSRYLGLAPMNKNPADESDAQGIRITIDDTSSWNGQQMMRSELIPQTSEDLGSGHLFYHFSLKTNKKNAPNPKFEHQIAFFESHFTELQYGQSGGSDNTLKWNADGQTHWSTTLQPRQWYNFAYEIDFDAKTVGLWASNGTEALTQVVKGVSASTSTNSADWHVGQLRLDNGDKGGKEDWFWSGVYVEKGPVTTSVKGPSS

SEQ ID NO: 48 - protein, 240 aa, Aspergillus wentii
GDVVWNGFFNSSITVDHFDQWSWSNQLEPFQWYIHGSGATSRYLGLAPMNKNPADESDAQGIRITIDDTSSWNGQQMMRSELIPQTSEDLGSGHLFYHFSLKTNKKNAPNPKFEHQIAFFESHFTELQYGQSGGSDNTLKWNADGQTHWSTTLQPRQWYNFAYEIDFDAKTVGLWASNGTEALTQVVKGVSASTSTNSADWHVGQLRLDNGDKGGKEDWFWSGVYVEKGPVTTSVKGPSS

SEQ ID NO: 49 - DNA, 948 bp, Acrophialophora fusispora
  sig_peptide (1)..(48)
  exon (1)..(552)
  Intron (553)..(624)
  exon (625)..(847)
  Intron (848)..(910)
  exon (911)..(948)
atgaaggctgcagcactgttcgctgccctcgcggcctcggtcgacggcgctgtcctctgggacggccgcttcaacgagttcacctcgtcggccgacctcaacaagtggtcgtggtcgaaccaggtcggcccctatcagtactacatccacggctcgggctccgtcgagaaatacgtcaacctgtcgcccgactacaagaacccggccgacaccgtgtccaagcagggcgccaagatcacgctcgacagcaccgcctactggaacgggcagaacatgcgccggaccgagctcatcccgcagaccaaggccgccatcaacagggggaaggtgttctaccacttcagcatgatgcgcaaggacaccaacgcgccgagcgtcaaccgcgagcaccagatctgcttctttgagagccacttcaccgagatgaagtacggctggatcagcggcgagcagggcacgagcaaccctaacctgcagtggatgacgaaccagcagagccgctggaagacggagtggaaggctggcgtgtggcacaacattgcctacgagattgtcagtaactagcctcagtggagtgtgaaaaggaggcgcgggagctgatgtgtgttttgcgttgctgtttaggacttctcggccaacaaggtcggcttctggcactcggagggcgcggagcccctgaagcaggtcgtggccccggtctcggtatcgacgtcatccaatggagccgactggcatctgggtgtcctcgagctgccgcggtctggatacccggataccaacgaggacttttacttctctggcgtctacatcgaggacggcaccattaccaccacgattggcgggcctggtaagtctcggcgttgatcagtcaaagtgctataccatgtggctaattcctttctagcgtaagagtaccaagccaagagcgagagggggttgttattctga

SEQ ID NO: 50 - protein, 270 aa, Acrophialophora fusispora
MKAAALFAALAASVDGAVLWDGRFNEFTSSADLNKWSWSNQVGPYQYYIHGSGSVEKYVNLSPDYKNPADTVSKQGAKITLDSTAYWNGQNMRRTELIPQTKAAINRGKVFYHFSMMRKDTNAPSVNREHQICFFESHFTEMKYGWISGEQGTSNPNLQWMTNQQSRWKTEWKAGVWHNIAYEIDFSANKVGFWHSEGAEPLKQVVAPVSVSTSSNGADWHLGVLELPRSGYPDTNEDFYFSGVYIEDGTITTTIGGPEYQAKSERGLLF

SEQ ID NO: 51 - protein, 254 aa, Acrophialophora fusispora
AVLWDGRFNEFTSSADLNKWSWSNQVGPYQYYIHGSGSVEKYVNLSPDYKNPADTVSKQGAKITLDSTAYWNGQNMRRTELIPQTKAAINRGKVFYHFSMMRKDTNAPSVNREHQICFFESHFTEMKYGWISGEQGTSNPNLQWMTNQQSRWKTEWKAGVWHNIAYEIDFSANKVGFWHSEGAEPLKQVVAPVSVSTSSNGADWHLGVLELPRSGYPDTNEDFYFSGVYIEDGTITTTIGGPEYQAKSERGLLF

SEQ ID NO: 52 - DNA, 941 bp, Acrophialophora fusispora
  sig_peptide (1)..(54)
  exon (1)..(653)
  Intron (654)..(712)
  exon (713)..(941)
atgcatcctgcaactctcctcggcgtgctcgcggccgccgtgacagtctcggcccgcccgcgtcaccacgcccgctcatgctctgcgacgggtgtcgacaccaagtgccccatcgtcttcgacgggcgtgtcaagaccaccacccagctcaccgacttcgacagctacgcgacctcgatcttcaacccggactacgtcaagggccaaaacctcaagtggagcgacatcatcaagttccccaccaccgccaacgcccgcttcgacaacgccacctacaagcccttcgaggtcaccatcagcgaccagagcatcttccagacccagcgcgggttccgccgcgcgggcctgcagttccagggtgacaccaacaacggcagtccggggagcactggcgtcaagacgctccatttcagcctcaagtgggacgcccagcgcgccctgaacctgagccatgagtacctgctggtgtggcacgaggccgccgactacagctccaaccagttcaacttcgaggccggcgccatcctgggccaggcgagcctgcccaaggacacgtacaaggtcctggaccgcaacaacaagcagatctggtcgacgcccatcctcaaggacgcctggcagaactttgccgtgacgctcgactttaacaagaagtgtgtccttccttcttttgtttggctttgcgacggaccagacgactgacagcccgcagcaccctccaagtgtactactccaagggcgccgagccgctcaagagcgtcaccagcgccgtgtccaacaataacgcgggagaaggccagtaccagatcggcatgctcaagaagccgaccggcaccagcgacgtcgtcaactcgggctaccaagagagcaacctcaacgagggcctcatttacggcagcctgttcctcgaggacagcgccaacaactgtgtgtcgttgtaa

SEQ ID NO: 53 - protein, 293 aa, Acrophialophora fusispora
MHPATLLGVLAAAVTVSARPRHHARSCSATGVDTKCPIVFDGRVKTTTQLTDFDSYATSIFNPDYVKGQNLKWSDIIKFPTTANARFDNATYKPFEVTISDQSIFQTQRGFRRAGLQFQGDTNNGSPGSTGVKTLHFSLKWDAQRALNLSHEYLLVWHEAADYSSNQFNFEAGAILGQASLPKDTYKVLDRNNKQIWSTPILKDAWQNFAVTLDFNKNTLQVYYSKGAEPLKSVTSAVSNNNAGEGQYQIGMLKKPTGTSDVVNSGYQESNLNEGLIYGSLFLEDSANNCVSL

SEQ ID NO: 54 - protein, 275 aa, Acrophialophora fusispora
RPRHHARSCSATGVDTKCPIVFDGRVKTTTQLTDFDSYATSIFNPDYVKGQNLKWSDIIKFPTTANARFDNATYKPFEVTISDQSIFQTQRGFRRAGLQFQGDTNNGSPGSTGVKTLHFSLKWDAQRALNLSHEYLLVWHEAADYSSNQFNFEAGAILGQASLPKDTYKVLDRNNKQIWSTPILKDAWQNFAVTLDFNKNTLQVYYSKGAEPLKSVTSAVSNNNAGEGQYQIGMLKKPTGTSDVVNSGYQESNLNEGLIYGSLFLEDSANNCVSL

SEQ ID NO: 55 - DNA, 955 bp, Rhinocladiella sp.
  sig_peptide (1)..(63)
  exon (1)..(435)
  Intron (436)..(485)
  exon (486)..(676)
  Intron (677)..(726)
  exon (727)..(955)
atgctgtccagagtcggagcttcaatgttttttggtcttgtggggttcggcttcgcggttgctgggcaaaacctcgtcaagtgtccagtcattctcgacggacgcgttccagccggaactcccttaacgttcttcgatacgtcgaacacactattcaatcccgatttcgtcaaaggaaacaacctgaagtggtcgcagatcttacagctgccaaacgtaacagcgtcacgcttcgatgccgcgggcggaaacattccagtcgaggtgaccatcagcgatgcctcgattttccagagccagaatggatttcggagagctggtctgcagtttgctgcggatagttccaacgatgcgagcgatacgggcatcaagaccatccacttcagcgtcaagcaagacccacagcgaaagctgaacctgacccatgagtatcttgtaggtgatggaggagctcgcactatagaatgctggctcataatttctagaacgtatggcacgagactgcagcatttgatgcgaaccaattcaactttgagattggcaccatcatcggaacgaacggagccgacaaatcgagcttcaagatcctcggtcggtcaaacaacaggatctacaccgtcgcagcggatcctcttgcctggcagaactttgcagtgaaactcgactacagcaaaaagttggtgaatcggaatgtttctcacgatcttagctgacggcggtctctagcactctccaggtattctactcgaagaacaacgacccattgaaggcagtgacatcggccgtgtccaacaacaatgcgggcgctggccagttccagattggcatgttgaagaagccgactggaacggcggatgttgtcaacagcggattccaggagcgtggtattaacgaaggacagatctacggcggtctgttcgtcgaggacagcgcgaatggttgcatctcgttatag

SEQ ID NO: 56 - protein, 284 aa, Rhinocladiella sp.
MLSRVGASMFFGLVGFGFAVAGQNLVKCPVILDGRVPAGTPLTFFDTSNTLFNPDFVKGNNLKWSQILQLPNVTASRFDAAGGNIPVEVTISDASIFQSQNGFRRAGLQFAADSSNDASDTGIKTIHFSVKQDPQRKLNLTHEYLNVWHETAAFDANQFNFEIGTIIGTNGADKSSFKILGRSNNRIYTVAADPLAWQNFAVKLDYSKNTLQVFYSKNNDPLKAVTSAVSNNNAGAGQFQIGMLKKPTGTADVVNSGFQERGINEGQIYGGLFVEDSANGCISL

SEQ ID NO: 57 - protein, 263 aa, Rhinocladiella sp.
GQNLVKCPVILDGRVPAGTPLTFFDTSNTLFNPDFVKGNNLKWSQILQLPNVTASRFDAAGGNIPVEVTISDASIFQSQNGFRRAGLQFAADSSNDASDTGIKTIHFSVKQDPQRKLNLTHEYLNVWHETAAFDANQFNFEIGTIIGTNGADKSSFKILGRSNNRIYTVAADPLAWQNFAVKLDYSKNTLQVFYSKNNDPLKAVTSAVSNNNAGAGQFQIGMLKKPTGTADVVNSGFQERGINEGQIYGGLFVEDSANGCISL

SEQ ID NO: 58 - DNA, 1116 bp, Nemania serpens
  sig_peptide (1)..(57)
  exon (1)..(453)
  Intron (454)..(558)
  exon (559)..(746)
  Intron (747)..(887)
  exon (888)..(1116)
atggtgtcaactactctcctgagcagcatcctagctgccgccactctatcctcggccctgccgtcgctgctcgaggagcgcggggcgggctcgatcaagtgtccgatggttctcagcgggctggtgaagtcgtccctgacaccgaccgacttcgactcgtacgccacgagcccgttcaacccggactacgtccgcggcagcgagaagttcagccagagcctcaagttccccaacgtgacgggctcgcgcttcgacaacgccaccaccaagcccatcgaggtcaccatcaacgacaaatccatcttccagacccagaacggcttccggcgcgccggcctgcagatccagggcgacactaaccagggcgggcctggcacggccggcatccggacgctacactttagcgtcaagcaggacccccagaggaagctgaacctgacacatgagtatctggtgagttgtagcataagattccgtcgggataataaaagtctacggcgaattataagtaaatagccgtagaccacccgtattaatgactaattaccgtgtccctagaacgtctggcacgaaacagccgactacagcgccaaccagttcaactttcagacggggacgatcatcgggcgttccggcaacaagaacaccttcaaggtcctcaaccggcagaacacggaggtctggtcgacgccgatcgacgagacggcgtggcagaacttcgccatcacgctagatttcgccaaaaagtaagcaagtttggaacttctgtctctgtctctttctctctctttctctctttctgtgatgaacaagaacacacgcaagacgggaacgttgcacattcacaaatagcaacaaactaacaaacggactctcgcgcgccgcagcaccctgcgcgtctactactccaagaacgacgagccgctcaagtccgtcacgtcggcgctgtacaacgacaactcgggcggcggccagtaccagatcggcatcctcaagaagcccacgggcacctcggacgtcgtcaactcgggctaccaggagaagaacctcaacgagggccaggtctacggcggcctgttcctcgaggacagcgccggcggctgcgtctcgctgtag

SEQ ID NO: 59 - protein, 289 aa, Nemania serpens
MVSTTLLSSILAAATLSSALPSLLEERGAGSIKCPMVLSGLVKSSLTPTDFDSYATSPFNPDYVRGSEKFSQSLKFPNVTGSRFDNATTKPIEVTINDKSIFQTQNGFRRAGLQIQGDTNQGGPGTAGIRTLHFSVKQDPQRKLNLTHEYLNVWHETADYSANQFNFQTGTIIGRSGNKNTFKVLNRQNTEVWSTPIDETAWQNFAITLDFAKNTLRVYYSKNDEPLKSVTSALYNDNSGGGQYQIGILKKPTGTSDVVNSGYQEKNLNEGQVYGGLFLEDSAGGCVSL

SEQ ID NO: 60 - protein, 270 aa, Nemania serpens
LPSLLEERGAGSIKCPMVLSGLVKSSLTPTDFDSYATSPFNPDYVRGSEKFSQSLKFPNVTGSRFDNATTKPIEVTINDKSIFQTQNGFRRAGLQIQGDTNQGGPGTAGIRTLHFSVKQDPQRKLNLTHEYLNVWHETADYSANQFNFQTGTIIGRSGNKNTFKVLNRQNTEVWSTPIDETAWQNFAITLDFAKNTLRVYYSKNDEPLKSVTSALYNDNSGGGQYQIGILKKPTGTSDVVNSGYQEKNLNEGQVYGGLFLEDSAGGCVSL

SEQ ID NO: 61 - DNA, 989 bp, Talaromyces leycettanus
  sig_peptide (1)..(51)
  exon (1)..(112)
  Intron (113)..(182)
  exon (183)..(319)
  Intron (320)..(389)
  exon (390)..(554)
  Intron (555)..(608)
  exon (609)..(989)
atgaaagccaattatctactgctcacctctttaccggctctcggccagtgcggccaggttctctggagtggattgttcaactcctccttcacggtggccgactttgataaatgtcagtcctccgagtatcgtcgagacccatccccgcctgcattgctccaggggaactaacctactcatagggtcatggtcaaaccaaatccagccatggcagtggtatattcacggcccttcgccaactagcgaatatctcggtttgtccccgagcttcaagaatcctgccgataccagcgatgcccagggcatccggattaccattgtatgtatggctggggttatctttccctgacaaattctagacacggccagacactaatttatgagccaaggatggaacgtctttctgggagggacaaaacatggagcgcactgagatcattccccagacctccacgaacctggggaccggccatctgtactatcacttctcgttgaggacgaccaacgtcaatccacccaatccaggattcgaacatcagattgctttcttcgaggtaacttgatcaatgtccatcagattcatagtctagtaatgactgtctttgcagagccacttcaccgaaatcaagtacgggctcctcagcggagagtctggaacgaccgacaacaccctccgatggatggtgaccggcaacacgcagtggtctacccagctggtgcctggaaactggtacaactttgcctacgacatcgatttcggcgcccagacggtcgggctctgggcgtcaaatggctcgaaccccttgacgcaagtagtcccaggcgtgaaagcgtccacttctacgaactcgcaggattggcatatcggcgagttgaggttgcccaacggtggtagtaattctgcacctgaggactggtactggtctggcatctttgtggaatcggctccgattacaacgagcattgctggaccgtctccagcggcgtga

SEQ ID NO: 62 - protein, 264 aa, Talaromyces leycettanus
MKANYLLLTSLPALGQCGQVLWSGLFNSSFTVADFDKWSWSNQIQPWQWYIHGPSPTSEYLGLSPSFKNPADTSDAQGIRITIDGTSFWEGQNMERTEIIPQTSTNLGTGHLYYHFSLRTTNVNPPNPGFEHQIAFFESHFTEIKYGLLSGESGTTDNTLRWMVTGNTQWSTQLVPGNWYNFAYDIDFGAQTVGLWASNGSNPLTQVVPGVKASTSTNSQDWHIGELRLPNGGSNSAPEDWYWSGIFVESAPITTSIAGPSPAA

SEQ ID NO: 63 - protein, 247 aa, Talaromyces leycettanus
GQVLWSGLFNSSFTVADFDKWSWSNQIQPWQWYIHGPSPTSEYLGLSPSFKNPADTSDAQGIRITIDGTSFWEGQNMERTEIIPQTSTNLGTGHLYYHFSLRTTNVNPPNPGFEHQIAFFESHFTEIKYGLLSGESGTTDNTLRWMVTGNTQWSTQLVPGNWYNFAYDIDFGAQTVGLWASNGSNPLTQVVPGVKASTSTNSQDWHIGELRLPNGGSNSAPEDWYWSGIFVESAPITTSIAGPSPAA

SEQ ID NO: 64 - DNA, 1134 bp, Collariella virescens
  sig_peptide (1)..(54)
  exon (1)..(784)
  Intron (785)..(838)
  exon (839)..(1134)
atgaagctctcggtgctgtccgccgtcgtcgccaacgccctgtccgtttcggcaggcaccatcctctgggatggccgcttcaacgacctcacatcgtcgaccgacctcaacaagtggtcgtgggcgaaccaggttggcccttaccagtactacatccacggctcgtccgacgtgactgcctacgtcaacctgtcgcccgactacaagaacccggccgacacggggtccaaacagggcgccaagattaccctcgacagtaccgcctactggaatggccagaacatgcgccgtaccgagctgatcccccagaccaccgccgccatcaacaagggcaaggtctactaccacttctcgctgatgcgcaaggacaccaacgcccccgctaccacccgcgagcaccagatcgccttcttcgagagccacttcaccgagctcaaggccggctggctgtcgggctcccccggcgtgtccgacaccctactgcgctggtgtgtcagcggccagaccaagtggagcaccgagtgggaggccaacgtctggcacaacgtggcctacgagattgacttcgacgccaacacggtcggcttctggcactcgaccggcagcgacccgctaacccagaaagtcgcccccgtgagtgcgagcactagcagcaacggcgctgactggcaccttggtgtgctcgagctgccacgctcaggctaccccgacaccgacgaggactactactggtccggtgtctacattgagagcggcagcctgaccacttctgtggctggccctggttagcagcacccaggcaaggcgtattatcgcccagcaagctaatatattacaggttccgctcccggcggcggcagcagcagcagcagtgccgtcagcagcaccaccaagacacctgccacctcgaccacgctcatcacctccaccaccaaggcttcaacgactaccaccaaagtccagtcgagctccaccaccagctccgcgccttccacctccaccagcgcgagcagcggcggctgcactgcctcgcagtggtcgcagtgtggcggcatcaacttcaccggttgcaagacctgcgcggcgccttacacctgcaagtatctcaatgactggtactcgcagtgcctctaa

SEQ ID NO: 65 - protein, 359 aa, Collariella virescens
MKLSVLSAVVANALSVSAGTILWDGRFNDLTSSTDLNKWSWANQVGPYQYYIHGSSDVTAYVNLSPDYKNPADTGSKQGAKITLDSTAYWNGQNMRRTELIPQTTAAINKGKVYYHFSLMRKDTNAPATTREHQIAFFESHFTELKAGWLSGSPGVSDTLLRWCVSGQTKWSTEWEANVWHNVAYEIDFDANTVGFWHSTGSDPLTQKVAPVSASTSSNGADWHLGVLELPRSGYPDTDEDYYWSGVYIESGSLTTSVAGPGSAPGGGSSSSSAVSSTTKTPATSTTLITSTTKASTTTTKVQSSSTTSSAPSTSTSASSGGCTASQWSQCGGINFTGCKTCAAPYTCKYLNDWYSQCL

SEQ ID NO: 66 - protein, 341 aa, Collariella virescens
GTILWDGRFNDLTSSTDLNKWSWANQVGPYQYYIHGSSDVTAYVNLSPDYKNPADTGSKQGAKITLDSTAYWNGQNMRRTELIPQTTAAINKGKVYYHFSLMRKDTNAPATTREHQIAFFESHFTELKAGWLSGSPGVSDTLLRWCVSGQTKWSTEWEANVWHNVAYEIDFDANTVGFWHSTGSDPLTQKVAPVSASTSSNGADWHLGVLELPRSGYPDTDEDYYWSGVYIESGSLTTSVAGPGSAPGGGSSSSSAVSSTTKTPATSTTLITSTTKASTTTTKVQSSSTTSSAPSTSTSASSGGCTASQWSQCGGINFTGCKTCAAPYTCKYLNDWYSQCL

SEQ ID NO: 67 - DNA, 1165 bp, Rigidoporus sp.74222
  sig_peptide (1)..(57)
  exon (1)..(137)
  Intron (138)..(192)
  exon (193)..(223)
  Intron (224)..(279)
  exon (280)..(610)
  Intron (611)..(666)
  exon (667)..(941)
  Intron (942)..(997)
  exon (998)..(1165)
atgttttccttcgctcccttgttgcttgtagctcttagttccctactggcgtctgcgacgcctattatttacgacggtcgtgcttcgttcaacctcaccgctgctaaccttgacgctaacaagggacctttcttaacgtgagtagtcttacaatatgtaatactcgctatgtctgaagacaacattccccagtgttgttaagggttctcaaaacgcctctcatgtgtgtattcctattagtgatacctcgcgcaatatgttgatcgctatcttacatagtacaccacactccttggcaaaaacactctcgcaactcctctctggagtaaggctcgatacgttccctcggagcaagccgtttcggtctccatcgacaacagttccattttcacacccggtggcaatgcccagaacggcttcagacgtacagacttgatcgccgccaacgatggcgagcacaccgagctccttactaagatggaaagtggtgttaccgccttccacttttctatcaagaaggacgacgccaagcctctgaacttgtctcacgaataccaagtcgtattcgtcgagcctaacgatggaactcacgttttcgacctccaagtcggtgagtataggtattcttacaccaatccctgaattggccctaacaattcatggcaggatctcccttcactctccccactggtactcttcccgccaacaactccaacattctcaaaatccgcgatcacagctccaacgtcttgttctctaccgagttcacctcgaatgactggcacaacttcgccgttcaggtggactgggataagttgaagctcggtgtcttctattcgaagaacaaggcgcaactttcggctgtcaccaagctcgttgacaatgttggtgcaaagactggtgccgacggacagggtgacttccacttggcccttctcaaggtatgttttatttagttcacattttctcacctcaatcctgactgtaaccactctagcttcccattgctaaccctgccgataccgaagaccaacagaaagatgttgttcacttcggtattcaggaaggtaccactgaggcgatcctttactcgggcgttttcgttgagagtgtaacccaaggtgttagtgttggtctcggacgaactacaaaggccatcgcgtaa

SEQ ID NO: 68 - protein, 313 aa, Rigidoporus sp.74222
MFSFAPLLLVALSSLLASATPIIYDGRASFNLTAANLDANKGPFLTVVKGSQNASHYTTLLGKNTLATPLWSKARYVPSEQAVSVSIDNSSIFTPGGNAQNGFRRTDLIAANDGEHTELLTKMESGVTAFHFSIKKDDAKPLNLSHEYQVVFVEPNDGTHVFDLQVGSPFTLPTGTLPANNSNILKIRDHSSNVLFSTEFTSNDWHNFAVQVDWDKLKLGVFYSKNKAQLSAVTKLVDNVGAKTGADGQGDFHLALLKLPIANPADTEDQQKDVVHFGIQEGTTEAILYSGVFVESVTQGVSVGLGRTTKAIA

SEQ ID NO: 69 - protein, 294 aa, Rigidoporus sp.74222
TPIIYDGRASFNLTAANLDANKGPFLTVVKGSQNASHYTTLLGKNTLATPLWSKARYVPSEQAVSVSIDNSSIFTPGGNAQNGFRRTDLIAANDGEHTELLTKMESGVTAFHFSIKKDDAKPLNLSHEYQVVFVEPNDGTHVFDLQVGSPFTLPTGTLPANNSNILKIRDHSSNVLFSTEFTSNDWHNFAVQVDWDKLKLGVFYSKNKAQLSAVTKLVDNVGAKTGADGQGDFHLALLKLPIANPADTEDQQKDVVHFGIQEGTTEAILYSGVFVESVTQGVSVGLGRTTKAIA

SEQ ID NO: 70 - DNA, 1022 bp, Loramyces macrosporus
  sig_peptide (1)..(54)
  exon (1)..(160)
  Intron (161)..(212)
  exon (213)..(262)
  Intron (263)..(310)
  exon (311)..(720)
  Intron (721)..(772)
  exon (773)..(1022)
atgaaggcatcaatttcacttgtgtgtagtgcaattgcaattgcagcagcagcacaaaagtgtcctttgcaatttgatggacggattcccgcggatgcatcactttccttgtttgacaccagtgccagccctttcaatcctcaatatgtcctcggagcaggtaagattctcgccagagaaagatgattgcgcaacaactgaccaatatacaggccagaagtggagcagtgttcttcgattccctgccgttgaatcttcattggtaagctcttcatcctatttggaaccgcatttgctaagatgcgtaaagtttgatgcgaatggaacgaaagcccttgaagtaaccatctctccatcttcaatcttcaattctcaaactgggttccgccgctcggaactccttccggcctcgaataacggcacggatccttccacctcaggcgtgaagacgattcatttctctgttcagaaagataccgcacgtccgctcaatacatcgcacgaatatcaactattcttcctcgagtcaaataatttcagcacaaatcaggtcgtcctgaaatatggaaccatcattggaggaaaccccaatggcctcagcagcgatagtttgatggtggttggaaatgtgaactcgaaaccgataccattgttgtactcgacgagatttactgctggagcttggcacaactttgcaatcacattgaacttcactgctgggtaagcatagctccgcacagaaatagttgatctgctaataataaggcaacagtaccacccaagtctactactcaaggaacaatgatacgctagcacccgtcagtaaagcagtcaagaacgatgtcagtggacaaggccaatatcattttggtatcttgaagaagccaactggtggcggtagtgacattacgaagagcggataccaagagggagggatcaacgaaggtatcatatttggaggtatctttcaagaggacagcagctctgctggctgcattagcctcaaagcaaaaaagaagtga

SEQ ID NO: 71 - protein, 289 aa, Loramyces macrosporus
MKASISLVCSAIAIAAAAQKCPLQFDGRIPADASLSLFDTSASPFNPQYVLGAGQKWSSVLRFPAVESSLFDANGTKALEVTISPSSIFNSQTGFRRSELLPASNNGTDPSTSGVKTIHFSVQKDTARPLNTSHEYQLFFLESNNFSTNQVVLKYGTIIGGNPNGLSSDSLMVVGNVNSKPIPLLYSTRFTAGAWHNFAITLNFTAGTTQVYYSRNNDTLAPVSKAVKNDVSGQGQYHFGILKKPTGGGSDITKSGYQEGGINEGIIFGGIFQEDSSSAGCISLKAKKK

SEQ ID NO: 72 - protein, 271 aa, Loramyces macrosporus
QKCPLQFDGRIPADASLSLFDTSASPFNPQYVLGAGQKWSSVLRFPAVESSLFDANGTKALEVTISPSSIFNSQTGFRRSELLPASNNGTDPSTSGVKTIHFSVQKDTARPLNTSHEYQLFFLESNNFSTNQVVLKYGTIIGGNPNGLSSDSLMVVGNVNSKPIPLLYSTRFTAGAWHNFAITLNFTAGTTQVYYSRNNDTLAPVSKAVKNDVSGQGQYHFGILKKPTGGGSDITKSGYQEGGINEGIIFGGIFQEDSSSAGCISLKAKKK

SEQ ID NO: 73 - DNA, 1027 bp, Cornyascus sepedonium
  sig_peptide (1)..(48)
  exon (1)..(552)
  Intron (553)..(690)
  exon (691)..(913)
  Intron (914)..(995)
  exon (996)..(1027)
atgaaagcgactacgctgctcgcagctctcgcggcatgtgccgagggtgccgtcctgtgggatgggcggttcaacgacctgacgagctcggcggacctcaacaagtggtcgtggagcaaccaggtcgggccctaccagtactacatccacgggtccggcacggtggataagtacatcaacctgtcgcccgactacaagaacccggccgatacggtgtcgaagcagggggcgcgcttcacgctcgacagcacggccttctggaacgggcagaacatgcgccggaccgagctcatcccccagacgaccgcggccatcaacaggggcaaggtgtactaccacttcagcatgatgcggaaggacaccaacgcgccgagtgccgagcgcgaacaccagatctgcttcttcgagagccacttcaccgagatgaagtacggctggatcagcggcgagtcgggcacgagcaaccccaacctgcagtggatgaccaaccagcagagccactggaagactgagtggctgcctgatgtgtggcacaacattgcctatgagattgtgagtgttgccctctcgagttttcattctttcttattttttttttacttctccattcctttttaagaaagaaagacgagagcgttctgagaagagccaagattgctgacttgctgcccttgcgcgccccgtctttaggacttcagcgccaacacggttggtttctggcactcggagggtgcagagccgctcaagcaggtggttgcgcctgtttcggtttcaacctcgtccaacggcgccgactggcatctaggcgtgctggagctgccccggtccggctacgccgatgccaacgaggacttttacttctcgggcgtctacgtcgaggacggcactatcaccaccgagattggcggccctggtaagctttatttttcctctacttgttgtctcggcgggcacaagggactgatgttcgttcgtcgcagcgtaaacctcatgagtcgggaggcaaaaggagcgagggacgggttga

SEQ ID NO: 74 - protein, 268 aa, Cornyascus sepedonium
MKATTLLAALAACAEGAVLWDGRFNDLTSSADLNKWSWSNQVGPYQYYIHGSGTVDKYINLSPDYKNPADTVSKQGARFTLDSTAFWNGQNMRRTELIPQTTAAINRGKVYYHFSMMRKDTNAPSAEREHQICFFESHFTEMKYGWISGESGTSNPNLQWMTNQQSHWKTEWLPDVWHNIAYEIDFSANTVGFWHSEGAEPLKQVVAPVSVSTSSNGADWHLGVLELPRSGYADANEDFYFSGVYVEDGTITTEIGGPVGRQKERGTG

SEQ ID NO: 75 - protein, 252 aa, Cornyascus sepedonium
AVLWDGRFNDLTSSADLNKWSWSNQVGPYQYYIHGSGTVDKYINLSPDYKNPADTVSKQGARFTLDSTAFWNGQNMRRTELIPQTTAAINRGKVYYHFSMMRKDTNAPSAEREHQICFFESHFTEMKYGWISGESGTSNPNLQWMTNQQSHWKTEWLPDVWHNIAYEIDFSANTVGFWHSEGAEPLKQVVAPVSVSTSSNGADWHLGVLELPRSGYADANEDFYFSGVYVEDGTITTEIGGPVGRQKERGTG

SEQ ID NO: 76 - DNA, 1348 bp, Fusarium solani
  sig_peptide (1)..(51)
  exon (1)..(175)
  Intron (176)..(227)
  exon (228)..(1348)
atgcagtactcgagtctggtttcgtttcttcttttcaacgccgtccacgcatggctccctcatgagcaggacttggcggctttcaacctgactgctcgctttgagcagcttggcaagcgcttcgagcctactcttgctcccggcatcaacaagatccgtggcgtcaactttggtggtaagtacccatcctgagtatggtctcttgatgcaaatctgattatctctaggctggctcgtctgcgaaccttggttgcagcgaaatgagtgggagaacaacatgaagtgcggccagtccgtctccgagtttgactgcatgcgagagcattactctggaagcaaccgtgaggctggtaaccaggcctttgagactcactggaagaactggatcaacacggccactgtccagtccgtccacgatgtcggtctgaacaccatacgtatccccatcggttactggtcttacgtcgacattgtcgacaaggccagcgagccttttgctgatggcaaccgtatgctgccttaccttgatgctgttgtcggcaaggctgccgacctcggtctctatgtcatcattgatctccacggtgctcccggtggtcaacaggaggacgtcttcaccggccagaacaacaagcctgctggcttctacaacgactacaactttggtcgtgcccagaggtggctcacctggatgaccaagcgcattcacagcaacaccgcctaccgaaccgtcggtatgatcgaggtcctcaacgagcctgtctcccgccacgacggaggcaaccgttacccagcccccggccaagaccccggcctggtccagaagtactatcccggtgctctcaaggccgttcgcgatgccgaatcttctctcggcgtccccaacaacaagaagctccacgtgcagttcatgtccaagaagtgggactctggtgacgcccgcacccaggccagcatcgccaacgaccccttcaccggcttcgacgatcacaactacatcggcttcgccttgaacgacaacgaccgcggtgaccagtacaagctgatgcacagcgcctgcaccgactcacgcgtcattagcggccaagactttgccatcactggcgagtggagcatgacctccaatgtggactggcacaacaaggactttttcaacaagttctttaccgctcagcagcagctatacgagagtcccggtatggacggatgggtctactggacctggaagactgagctcaacgaccctcgctggacttactctcatgctactgctctggactacatccctaaggatgctgctggacttgagaagaacgtttaccgcgatgtctgtgctggattcaggtaa

SEQ ID NO: 77 - protein, 431 aa, Fusarium solani
  sig_peptide (1)..(17)
MQYSSLVSFLLFNAVHAWLPHEQDLAAFNLTARFEQLGKRFEPTLAPGINKIRGVNFGGWLVCEPWLQRNEWENNMKCGQSVSEFDCMREHYSGSNREAGNQAFETHWKNWINTATVQSVHDVGLNTIRIPIGYWSYVDIVDKASEPFADGNRMLPYLDAVVGKAADLGLYVIIDLHGAPGGQQEDVFTGQNNKPAGFYNDYNFGRAQRWLTWMTKRIHSNTAYRTVGMIEVLNEPVSRHDGGNRYPAPGQDPGLVQKYYPGALKAVRDAESSLGVPNNKKLHVQFMSKKWDSGDARTQASIANDPFTGFDDHNYIGFALNDNDRGDQYKLMHSACTDSRVISGQDFAITGEWSMTSNVDWHNKDFFNKFFTAQQQLYESPGMDGWVYWTWKTELNDPRWTYSHATALDYIPKDAAGLEKNVYRDVCAGFR

SEQ ID NO: 78 - protein, 414 aa, Fusarium solani
WLPHEQDLAAFNLTARFEQLGKRFEPTLAPGINKIRGVNFGGWLVCEPWLQRNEWENNMKCGQSVSEFDCMREHYSGSNREAGNQAFETHWKNWINTATVQSVHDVGLNTIRIPIGYWSYVDIVDKASEPFADGNRMLPYLDAVVGKAADLGLYVIIDLHGAPGGQQEDVFTGQNNKPAGFYNDYNFGRAQRWLTWMTKRIHSNTAYRTVGMIEVLNEPVSRHDGGNRYPAPGQDPGLVQKYYPGALKAVRDAESSLGVPNNKKLHVQFMSKKWDSGDARTQASIANDPFTGFDDHNYIGFALNDNDRGDQYKLMHSACTDSRVISGQDFAITGEWSMTSNVDWHNKDFFNKFFTAQQQLYESPGMDGWVYWTWKTELNDPRWTYSHATALDYIPKDAAGLEKNVYRDVCAGFR

SEQ ID NO: 79 - DNA, 1520 bp, Gilmaniella humicola
  sig_peptide (1)..(48)
  exon (1)..(862)
  Intron (863)..(918)
  exon (919)..(1520)
atgcgtgctcccttacttgttactctcggagctactctgggagctgctctccctgctgacaatgcattcgacgcccgccaagctggtgcctcagcatgggcctccaacggcggcaaccttaagctgtcatcggtcccagctcctgttagaggcgccggatctcctggttccgagtcaacatggaaactcagcattgatgatactgcttctggccacaaacagaccatcaccggattcggtgcagcggtaactgatgctactgtgacctccttcaataccctttccagtagtagcctcagttcccttctcagccagctgatgacctctgctggtgctggcttcagtcttatgcgccatactatcggagcgtctgacttatccggtgacccagcatacacctacgatgataatggaggtagagctgatcccaatttgggcggcttcaacctaggtgatagaggcaatgccatggctcaaatgcttgccaggatgaagtcgctacagccaaatctgaaaatacttggctctccatggagtgctcctggctggatgaagctgaatggtgtcattgatggaacgacaaataacaacaaccttaacgatggctatctgactaataacggcgctcaatactctagcgcttttgctcagtattttgttaagtacattcaggcttattctaaccaaggcgctcatatcgatgccatcactctccagaatgaacctttgaacagccaagcgggctatcctaccatgtatatgttcgactatgagcaggctaacctcattaatggttatgtcggccctgccttgagaaatgcaggtttgaacactgaaatctgggcatatgatcacaatacaggtatatatacagcctcttgcaacaatatcacgagacatttagctcactctttatagatgtgccttcattcccacagaatgttctgagccaggctggggggtacactagcactgtggcttggcactgctatgctaaccccattgactggactgttctcactcgattccaccagagcttcccaaattccaaacagtacatgaccgagtgctggactcctgccggcagctggaaccaagctgctgacttcaccatgggccctcttcagaactgggcatccggtgttactgcctggactcttggtactaatgctcaagatggtcctcatctctccagcggcggctgtggcaactgccaaggtttggtcactatcaacaatggtggtttcaccttcaaccccgcctactacatgatggctcaatttagcaaatttatgcctcctggagctatcgtgcttaacggcagcggtagctacacatactctggaggcggcggtgtgcagtctgttgcgtctctgaatccagacggaactcgaaccgtcgtcattgagaatacctttaccaatgatatctacatcactctgactaccaactcaggagaacaatggagtggcaatatccccacctcatctgttaccacctgggttcttcctccggtttag

SEQ ID NO: 80 - protein, 487 aa, Gilmaniella humicola
  sig_peptide (1)..(16)
MRAPLLVTLGATLGAALPADNAFDARQAGASAWASNGGNLKLSSVPAPVRGAGSPGSESTWKLSIDDTASGHKQTITGFGAAVTDATVTSFNTLSSSSLSSLLSQLMTSAGAGFSLMRHTIGASDLSGDPAYTYDDNGGRADPNLGGFNLGDRGNAMAQMLARMKSLQPNLKILGSPWSAPGWMKLNGVIDGTTNNNNLNDGYLTNNGAQYSSAFAQYFVKYIQAYSNQGAHIDAITLQNEPLNSQAGYPTMYMFDYEQANLINGYVGPALRNAGLNTEIWAYDHNTDVPSFPQNVLSQAGGYTSTVAWHCYANPIDWTVLTRFHQSFPNSKQYMTECWTPAGSWNQAADFTMGPLQNWASGVTAWTLGTNAQDGPHLSSGGCGNCQGLVTINNGGFTFNPAYYMMAQFSKFMPPGAIVLNGSGSYTYSGGGGVQSVASLNPDGTRTVVIENTFTNDIYITLTTNSGEQWSGNIPTSSVTTWVLPPV

SEQ ID NO: 81 - protein, 471 aa, Gilmaniella humicola
LPADNAFDARQAGASAWASNGGNLKLSSVPAPVRGAGSPGSESTWKLSIDDTASGHKQTITGFGAAVTDATVTSFNTLSSSSLSSLLSQLMTSAGAGFSLMRHTIGASDLSGDPAYTYDDNGGRADPNLGGFNLGDRGNAMAQMLARMKSLQPNLKILGSPWSAPGWMKLNGVIDGTTNNNNLNDGYLTNNGAQYSSAFAQYFVKYIQAYSNQGAHIDAITLQNEPLNSQAGYPTMYMFDYEQANLINGYVGPALRNAGLNTEIWAYDHNTDVPSFPQNVLSQAGGYTSTVAWHCYANPIDWTVLTRFHQSFPNSKQYMTECWTPAGSWNQAADFTMGPLQNWASGVTAWTLGTNAQDGPHLSSGGCGNCQGLVTINNGGFTFNPAYYMMAQFSKFMPPGAIVLNGSGSYTYSGGGGVQSVASLNPDGTRTVVIENTFTNDIYITLTTNSGEQWSGNIPTSSVTTWVLPPV

SEQ ID NO: 82 - DNA, 1377 bp, Gliomastix murorum
  CDS (1)..(1377)
  sig_peptide (1)..(57)
atgcggttcttctccctcgccgccgccctcctcgggtcggcgtccctcgcctcggccctccccaaggccgtctcgcactcgcagacgcccgacggcttcctcgaggtcaagccgggcacgttcaaggacctcaaggtcacgtacgagaacacgctcaacggcacgtacaaggaggaggagtcgcgcatcgtgccggctccttcttctgacgctgctgctgctcttgctgacggcgaggtcggcgcccaggcgacgctgggcctcaacttcgtcaacaacttcggcgggcccatcaacgcgtacatcacgggcaaggacgagtccggccgggtcgtgttcgtccgcggcgacggcagcctgctgtacccgagctccggagggtccgcgacgcccgtgcccgtcggccaggacggacgcatcccgctcgcggccgggcagaacttcaacatggtgctgcccatcgcgctcgagtcggcgcgcatctactactcggccggcgacctcatcttcggcgtcgtgcgcacgcccatcggtgatggtctcgtccagcccgcgcccaacaacccgtccgacccgagcgcgggcatcaactggggcttcgtcgagctgacgctgctgcccaacggcacgctgtacgccaacatcagctacgtcgacttcgtcggcctgccgctgggcatggagctcacggtcaacggcggcgacacgcagtcggcctttggcgtcggccgcggcgccgtgaccaacatctgcaacgcgctcagcgcccagggcagccgcgacggccgtccctggagccgtctctgcatgggcaacgccgcgggccccgtgcgcgcgctctcgccgacggcctacaccgacctcgacccggcctccttcgccgactactggcacgcctaccgcgaccaggtctgggaaaagtaccgcggcgagccgctcatcatcgacacccagcgcgagttcggccgcatcaactgctgggtccgcggcgacgccctcgagtgcgacggcgacaaccgcgcctacttcaagcccgaggccgtcgacatctggggctgcgaccgcgggcccttcggcaagcagtccggcgacaaccaggtgcacctcgccgtcatcccgcgcctctgcgccgcctttgtccgctccacgctgctcgtcggcggcggcaacgtccagccgggcctcggccaggccaactactaccgcgtcgagccgaccaaccactacagccgcgtcgtgcacgagaacgaggtcgacggcaaggggtacgccttcgcctacgacgatgtcaaccccacgggcacggagaacgcctctggtacggttgcgcatgccagcccgaacacgctgagggtgttcatcggcagccctccttga

SEQ ID NO: 83 - protein, 458 aa, Gliomastix murorum
MRFFSLAAALLGSASLASALPKAVSHSQTPDGFLEVKPGTFKDLKVTYENTLNGTYKEEESRIVPAPSSDAAAALADGEVGAQATLGLNFVNNFGGPINAYITGKDESGRVVFVRGDGSLLYPSSGGSATPVPVGQDGRIPLAAGQNFNMVLPIALESARIYYSAGDLIFGVVRTPIGDGLVQPAPNNPSDPSAGINWGFVELTLLPNGTLYANISYVDFVGLPLGMELTVNGGDTQSAFGVGRGAVTNICNALSAQGSRDGRPWSRLCMGNAAGPVRALSPTAYTDLDPASFADYWHAYRDQVWEKYRGEPLIIDTQREFGRINCWVRGDALECDGDNRAYFKPEAVDIWGCDRGPFGKQSGDNQVHLAVIPRLCAAFVRSTLLVGGGNVQPGLGQANYYRVEPTNHYSRVVHENEVDGKGYAFAYDDVNPTGTENASGTVAHASPNTLRVFIGSPP

SEQ ID NO: 84 - protein, 439 aa, Gliomastix murorum
LPKAVSHSQTPDGFLEVKPGTFKDLKVTYENTLNGTYKEEESRIVPAPSSDAAAALADGEVGAQATLGLNFVNNFGGPINAYITGKDESGRVVFVRGDGSLLYPSSGGSATPVPVGQDGRIPLAAGQNFNMVLPIALESARIYYSAGDLIFGVVRTPIGDGLVQPAPNNPSDPSAGINWGFVELTLLPNGTLYANISYVDFVGLPLGMELTVNGGDTQSAFGVGRGAVTNICNALSAQGSRDGRPWSRLCMGNAAGPVRALSPTAYTDLDPASFADYWHAYRDQVWEKYRGEPLIIDTQREFGRINCWVRGDALECDGDNRAYFKPEAVDIWGCDRGPFGKQSGDNQVHLAVIPRLCAAFVRSTLLVGGGNVQPGLGQANYYRVEPTNHYSRVVHENEVDGKGYAFAYDDVNPTGTENASGTVAHASPNTLRVFIGSPP

SEQ ID NO: 85 - DNA, 917 bp, Albifimbria verrucaria
  sig_peptide (1)..(57)
  exon (1)..(780)
  Intron (781)..(836)
  exon (837)..(917)
atgattcccaagcaaatcctcgcggctattgctgctctctctagcgtgtcccaggcatgggaagctccccagtattcgggcttcaaccgcgtctggcaggatacctttgccggcgccggcgggtccttgcctgaccaaggcaactggaacatcattaacggcgatctgggcgttaacaacgagctccagatttacaccaccagcactcgtaacgtccagcgcagtggcggagagacggtgcagctcgttccgtttagagatggatcggctctccgaggctggacatccggccgtctcgagagcaagtacacgtggactccgcaggctggcaggctcacccgggctgaagcgctcattcggttcggcaccaactccatcggcaacaagcagggtatttggcctgctttctgggctctcggagacatcctccgccgaggcggcagctggccatcgtgcggcgagttggatatcctcgagactgtcaacgggcagctgactggatacggaactatacactgcgatgtatacccaggcgggatttgcaacgagggaaacggcatcggtgcatccatcggcatccccgatcagggctggcacacttggcgccttgaggtagaccgtcgtccgggaaattggctggacgagagcatcacatggtaccgcgacggccagcaattccaccgcgtgacaggagccagaatcaacaactacaacgtctggaacgccctggcccactcccccatgttctttatcctcaacgttgcggtcgggggtaactgggtaagtctacatgctccaaagtgtatagctatgggatgaactaactattattgcagcctggataccccaacggtgctactcaggacggttacggtagcatgatggaagttgcgtacgtcgcacactattcgacctga

SEQ ID NO: 86 - protein, 286 aa, Albifimbria verrucaria
  sig_peptide (1)..(19)
MIPKQILAAIAALSSVSQAWEAPQYSGFNRVWQDTFAGAGGSLPDQGNWNIINGDLGVNNELQIYTTSTRNVQRSGGETVQLVPFRDGSALRGWTSGRLESKYTWTPQAGRLTRAEALIRFGTNSIGNKQGIWPAFWALGDILRRGGSWPSCGELDILETVNGQLTGYGTIHCDVYPGGICNEGNGIGASIGIPDQGWHTWRLEVDRRPGNWLDESITWYRDGQQFHRVTGARINNYNVWNALAHSPMFFILNVAVGGNWPGYPNGATQDGYGSMMEVAYVAHYST

SEQ ID NO: 87 - protein, 267 aa, Albifimbria verrucaria
WEAPQYSGFNRVWQDTFAGAGGSLPDQGNWNIINGDLGVNNELQIYTTSTRNVQRSGGETVQLVPFRDGSALRGWTSGRLESKYTWTPQAGRLTRAEALIRFGTNSIGNKQGIWPAFWALGDILRRGGSWPSCGELDILETVNGQLTGYGTIHCDVYPGGICNEGNGIGASIGIPDQGWHTWRLEVDRRPGNWLDESITWYRDGQQFHRVTGARINNYNVWNALAHSPMFFILNVAVGGNWPGYPNGATQDGYGSMMEVAYVAHYST

SEQ ID NO: 88 - DNA, 913 bp, Lecanicillium sp. WMM742
  sig_peptide (1)..(57)
  exon (1)..(771)
  Intron (772)..(829)
  exon (830)..(913)
atggtcaaggctggtttcatctcttctctcctgtccctggcagctttcactagtgcctgggacgctcccaactatggcggtttcaaccgagtctggcaggacaactttggcggtaatggcggccagcttcccaacgagggcaactggaacatcattactggcaacctcggtgtcaacaacgagctcgaggtttaccagcgtgacactcgcaacctgcagctgagcggtggcaacaccctgcagattgttccctggagaaacggcaatggctggacgtccggtcgcatcgagtccaagtacacctttactccccagggcggcaagctcactagagtcgaggctgctatccgcttcggcggcaacagcatcaacaacaaacagggcatctggcctgcgtggtggatgctcggcgatggtatccgccataatgttcaatggcctggatgcggtgagcttgacattctcgagactgtcaacggacagctcaccggccacggcaccatgcactgcgacacgttccccggcggtatctgcaacgagggtaacggtattggttcgtccgtcaacttccccaaccaagactggcacacctggcgcctggaggtcgatctccgcaacggcaactgggttgaccagagcatcgtgtggtatctggatggtcgcgagttccaccgcatcaccggtagccgcatcaacaactacaatgtgtggcgctctgttgctcagagccctctcttcttcatcctcaatgtcgctgttggtggcaactgggtaagcatctatctgtccaagaactgtgaaccagaacttgacgctaaccatttggcagcccggctaccccaacggaaacacccaggacggctatggcagcatgatggaagtcggctacactgctcactatgttacccagtga

SEQ ID NO: 89 - protein, 284 aa, Lecanicillium sp. WMM742
  sig_peptide (1)..(19)
MVKAGFISSLLSLAAFTSAWDAPNYGGFNRVWQDNFGGNGGQLPNEGNWNIITGNLGVNNELEVYQRDTRNLQLSGGNTLQIVPWRNGNGWTSGRIESKYTFTPQGGKLTRVEAAIRFGGNSINNKQGIWPAWWMLGDGIRHNVQWPGCGELDILETVNGQLTGHGTMHCDTFPGGICNEGNGIGSSVNFPNQDWHTWRLEVDLRNGNWVDQSIVWYLDGREFHRITGSRINNYNVWRSVAQSPLFFILNVAVGGNWPGYPNGNTQDGYGSMMEVGYTAHYVTQ

SEQ ID NO: 90 - protein, 265 aa, Lecanicillium sp. WMM742
WDAPNYGGFNRVWQDNFGGNGGQLPNEGNWNIITGNLGVNNELEVYQRDTRNLQLSGGNTLQIVPWRNGNGWTSGRIESKYTFTPQGGKLTRVEAAIRFGGNSINNKQGIWPAWWMLGDGIRHNVQWPGCGELDILETVNGQLTGHGTMHCDTFPGGICNEGNGIGSSVNFPNQDWHTWRLEVDLRNGNWVDQSIVWYLDGREFHRITGSRINNYNVWRSVAQSPLFFILNVAVGGNWPGYPNGNTQDGYGSMMEVGYTAHYVTQ

SEQ ID NO: 91 - DNA, 1426 bp, Rasamsonia byssochlamydoides
  sig_peptide (1)..(57)
  exon (1)..(564)
  Intron (565)..(624)
  exon (625)..(819)
  Intron (820)..(875)
  exon (876)..(1293)
  Intron (1294)..(1361)
  exon (1362)..(1426)
atgaagactgtcaccaccctctcgaccctttccgccctgtgcggcctggccactgcctggctgcccggcgttcataaggacatctattcggtcgacgggcagaatcacttcaacaagactgctgggtctgctgacaagcgctggctccctgcctcaggcaagatccgcggcgtcgacctgggctcgctgttcgtcttcgagccctggatcgcggagaacgcatggagtcagatgggctgcggcggcaagcagtccgaattcgactgcgtgtctgccctcggccagagcgctgccaactcggccttcgccagccactggggcagctggatcaccaaggacgacatcacccagatgcagagctacgggctgaacacggtccgcattcctgtcggctactggctgaaggaggatatcgtctacagcgacagcgagcacttcccccagggcggcctgtcctatctcgagcaggtctgtggctgggccagcgatgccggtttctacatcattatcgatctgcacggtgcgccgggggctcaggtgcctcagaaccctgacacgggtcaggtgagaaggcctcctgaaacagtaagtatataatcttctaacgtctttctacacgtatagtacgctcccaccgctggtttctacgtcgactaccagtacgagcgcgccctcgagttcctcgagtggatgacgaccaacatccacaccaacaacaacttccggaacgttggcatgctggaaatcgtcaacgagcctcttcagaatccggatcaggtcgccacaatgcgaaccagctactacccaaatgccttcagcgtatgtccttcactctgcttctgacgaggagaacaaccgtattgacttttgtctagagaatccgcgccgccgagcagaaactcggcatcaccgccaacaactacctgcacatccagatgatgaacgccaaatggggctcaggcgacccgacccaggcgctgacggacacctacttcgccgcgtacgacgaccaccggtacctgaaatgggactcgagcgtgccagtctcgccgcagagctacctcagcacgtcgtgcaacgacgaccgcggcggaaactggccgaccatcgtgggcgagttcagcctcagcccgccagacgacgtacagtggacggcggagtgggatcctggcacgaaccaggatttctacaagaagtggtttgcggcccaggtcatggcgtacgagaagcagcagggctggatcttctggacgtggaagtcgcagctgggtgactatcggtggtcttatcagggtgagtaatatccttctgagggctgacaagttggataatatgttagaaaactaacagctgatctatagacgctgttgccgccggcgttatccccacggacctggattcggtctataacatgggtgcgtgctaa

SEQ ID NO: 92 - protein, 413 aa, Rasamsonia byssochlamydoides
  sig_peptide (1)..(19)
MKTVTTLSTLSALCGLATAWLPGVHKDIYSVDGQNHFNKTAGSADKRWLPASGKIRGVDLGSLFVFEPWIAENAWSQMGCGGKQSEFDCVSALGQSAANSAFASHWGSWITKDDITQMQSYGLNTVRIPVGYWLKEDIVYSDSEHFPQGGLSYLEQVCGWASDAGFYIIIDLHGAPGAQVPQNPDTGQYAPTAGFYVDYQYERALEFLEWMTTNIHTNNNFRNVGMLEIVNEPLQNPDQVATMRTSYYPNAFSRIRAAEQKLGITANNYLHIQMMNAKWGSGDPTQALTDTYFAAYDDHRYLKWDSSVPVSPQSYLSTSCNDDRGGNWPTIVGEFSLSPPDDVQWTAEWDPGTNQDFYKKWFAAQVMAYEKQQGWIFWTWKSQLGDYRWSYQDAVAAGVIPTDLDSVYNMGAC

SEQ ID NO: 93 - protein, 394 aa, Rasamsonia byssochlamydoides
WLPGVHKDIYSVDGQNHFNKTAGSADKRWLPASGKIRGVDLGSLFVFEPWIAENAWSQMGCGGKQSEFDCVSALGQSAANSAFASHWGSWITKDDITQMQSYGLNTVRIPVGYWLKEDIVYSDSEHFPQGGLSYLEQVCGWASDAGFYIIIDLHGAPGAQVPQNPDTGQYAPTAGFYVDYQYERALEFLEWMTTNIHTNNNFRNVGMLEIVNEPLQNPDQVATMRTSYYPNAFSRIRAAEQKLGITANNYLHIQMMNAKWGSGDPTQALTDTYFAAYDDHRYLKWDSSVPVSPQSYLSTSCNDDRGGNWPTIVGEFSLSPPDDVQWTAEWDPGTNQDFYKKWFAAQVMAYEKQQGWIFWTWKSQLGDYRWSYQDAVAAGVIPTDLDSVYNMGAC

SEQ ID NO: 94 - DNA, 1351 bp, Trichoderma longipile
  sig_peptide (1)..(51)
  exon (1)..(175)
  Intron (176)..(236)
  exon (237)..(1351)
atgcgatactccatcgttgccccggctgttctcgccggcaccgcctttgcatggcttcctcaagaccgcgatttggcggccttcaaccagaccgctcgttttgagcaggtcggcaagcgttttgagccttcacttgcttctggtatcacgaagatccgtggtgtcaacttcggtggtaagttaatactcaatacttgcagaaagacaaggaaacacacccttacacatcgatctaggatggcttatctgcgagccatggatgatgtccaatgagtggaacaatgtcatgggttgcaatggtgctgcctctgagttcgattgcatgctccaacactacatgggcaacaatcgtgcgctcggaaaccagaagttccagaaccactggagagactggattaaccccgccaccgttcagtccgttcatgatgtcggcttgaacactatccgtattcccattggctactggtcctacacagccattgtcgacacggctagcgagccatttgctgatggcaacctcatgctcccataccttgacgcggttgtccagaaggccgctgatctcgggatctacgtcattattgatctccacggcgctcctggtggtcagcaacaggatgtcttcaccggccagaaccccaaccccgcaggtttctacaactcatacgactatggccgtgctgagaagtggttgtcctggatgacaaaccgtatccacaccaaccctgcatactcaactgttggtatgattgaggttctcaacgagcctgtctccaggcacgatggaggcggccgctatcctgctcctggccaagacccaagcctggtgcaaacctactacccaggtgccctcaaggctgtccgtgatgctgaggcttcgctgaacgttcccagcaacaagaagctgcacgtgcagttcatgtccagcaagtgggattcaggcgatgctcgcaccaactctgctgtcgcaaacgaccccatgactggattcgacgatcacaactacattggttttgccctcagcaacactggcgaccaatactcgctcatgcacagtgcatgcactgactcacgtgttgtgaacggccagagcttcgccatcacaggcgagtggagcatgacgtctggtgccgattggcacgacgcaaacttcttcaagaagttcttcacagctcagcagcagctttatgagtctcctggaatggacggatggatctattggacctggaagaccgagttgaacgaccctcgatggacctactcttatgctacctacctcaactacgtcccaactaacgccgctgccctgcagcagaacgtttaccaggatgtttgcaccggatacaggtaa

SEQ ID NO: 95 - protein, 429 aa, Trichoderma longipile
  sig_peptide (1)..(17)
MRYSIVAPAVLAGTAFAWLPQDRDLAAFNQTARFEQVGKRFEPSLASGITKIRGVNFGGWLICEPWMMSNEWNNVMGCNGAASEFDCMLQHYMGNNRALGNQKFQNHWRDWINPATVQSVHDVGLNTIRIPIGYWSYTAIVDTASEPFADGNLMLPYLDAVVQKAADLGIYVIIDLHGAPGGQQQDVFTGQNPNPAGFYNSYDYGRAEKWLSWMTNRIHTNPAYSTVGMIEVLNEPVSRHDGGGRYPAPGQDPSLVQTYYPGALKAVRDAEASLNVPSNKKLHVQFMSSKWDSGDARTNSAVANDPMTGFDDHNYIGFALSNTGDQYSLMHSACTDSRVVNGQSFAITGEWSMTSGADWHDANFFKKFFTAQQQLYESPGMDGWIYWTWKTELNDPRWTYSYATYLNYVPTNAAALQQNVYQDVCTGYR

SEQ ID NO: 96 - protein, 412 aa, Trichoderma longipile
WLPQDRDLAAFNQTARFEQVGKRFEPSLASGITKIRGVNFGGWLICEPWMMSNEWNNVMGCNGAASEFDCMLQHYMGNNRALGNQKFQNHWRDWINPATVQSVHDVGLNTIRIPIGYWSYTAIVDTASEPFADGNLMLPYLDAVVQKAADLGIYVIIDLHGAPGGQQQDVFTGQNPNPAGFYNSYDYGRAEKWLSWMTNRIHTNPAYSTVGMIEVLNEPVSRHDGGGRYPAPGQDPSLVQTYYPGALKAVRDAEASLNVPSNKKLHVQFMSSKWDSGDARTNSAVANDPMTGFDDHNYIGFALSNTGDQYSLMHSACTDSRVVNGQSFAITGEWSMTSGADWHDANFFKKFFTAQQQLYESPGMDGWIYWTWKTELNDPRWTYSYATYLNYVPTNAAALQQNVYQDVCTGYR

SEQ ID NO: 97 - DNA, 1348 bp, Trichoderma koningiopsis
  sig_peptide (1)..(51)
  exon (1)..(175)
  Intron (176)..(233)
  exon (234)..(1348)
atgcgttactctattgttgccccggctcttctcgccggcactgcctatgcctggcttcctcaggagcgggatctggctgccttcaaccagaccgctcgctttgagaaactcggcaagcgattcgaacctacgctggcttctggtgtcacgaagatccgaggtgtcaactttggtggtaagtttacatacgggcaattcctaaaacgtgataagccacttacatgggggtttaggctggcttatctgtgagccatggatgatgcccaccgagtggaacgatgtgatgggctgcaacaacgctgcatccgagtttgactgcatgcgaaacaactatatgggcaacaaccgcgcagcgggtaacgcaaagttcaagactcactggagcagctggatcactcccgataccgttcaatctgttcacgatgtcggcttgaacaccatccgaatccccattggctactggtcctacacagccattgtcgataccgccagcgagccatttgctgatggtgatgccatgctcccatacctcgatgcggtcgttcagaaggccgccgacttgggaatctatgtcatcattgatctccacggtgcccctggtggtcagcagcaagacgccttcaccggccagaaccccaaccctgccggcttcttcaactcatacgactttggccgtgccgagaagtggctctcatggatgaccaaccgcatccacaccaacccggcctactcgaccgtgggtatgatcgaggttctcaacgagcctgtttccaaccacgatgccaacggccgctaccctgcccctggtgagaacccgggcttgacccagacctactaccctgccgcactccaggctgtccgttctgccgagtctgccttgaacgttcccagcaacaagaagctgcatgtgcagttcatgtccagcaagtggggctctggcgaccctcgctccaactctgccgtcgccgccgactccatgactggattcgacgaccacaactacattggctttgctgtcagcaacaacggcgaccagtactcgctcatgcacagcgcctgcactgactctcgcgtcgtcagtggccagaactttgagatcactggtgaatggagcatgacctccggcgttgactggcacgaccaagccttcttcaccaagttctggaccgcccagcagcagctttacgagtcccctggaatggacggatggatctactggacctggaagactgagctgaacgacccccgatggacctactcctatgctacctacctcaactacatccctaccaacgctgctgccttggaacagaatgtttaccaggatgtctgcaacggattcaggtaa

SEQ ID NO: 98 - protein, 429 aa, Trichoderma koningiopsis
  sig_peptide (1)..(17)
MRYSIVAPALLAGTAYAWLPQERDLAAFNQTARFEKLGKRFEPTLASGVTKIRGVNFGGWLICEPWMMPTEWNDVMGCNNAASEFDCMRNNYMGNNRAAGNAKFKTHWSSWITPDTVQSVHDVGLNTIRIPIGYWSYTAIVDTASEPFADGDAMLPYLDAVVQKAADLGIYVIIDLHGAPGGQQQDAFTGQNPNPAGFFNSYDFGRAEKWLSWMTNRIHTNPAYSTVGMIEVLNEPVSNHDANGRYPAPGENPGLTQTYYPAALQAVRSAESALNVPSNKKLHVQFMSSKWGSGDPRSNSAVAADSMTGFDDHNYIGFAVSNNGDQYSLMHSACTDSRVVSGQNFEITGEWSMTSGVDWHDQAFFTKFWTAQQQLYESPGMDGWIYWTWKTELNDPRWTYSYATYLNYIPTNAAALEQNVYQDVCNGFR

SEQ ID NO: 99 - protein, 412 aa, Trichoderma koningiopsis
WLPQERDLAAFNQTARFEKLGKRFEPTLASGVTKIRGVNFGGWLICEPWMMPTEWNDVMGCNNAASEFDCMRNNYMGNNRAAGNAKFKTHWSSWITPDTVQSVHDVGLNTIRIPIGYWSYTAIVDTASEPFADGDAMLPYLDAVVQKAADLGIYVIIDLHGAPGGQQQDAFTGQNPNPAGFFNSYDFGRAEKWLSWMTNRIHTNPAYSTVGMIEVLNEPVSNHDANGRYPAPGENPGLTQTYYPAALQAVRSAESALNVPSNKKLHVQFMSSKWGSGDPRSNSAVAADSMTGFDDHNYIGFAVSNNGDQYSLMHSACTDSRVVSGQNFEITGEWSMTSGVDWHDQAFFTKFWTAQQQLYESPGMDGWIYWTWKTELNDPRWTYSYATYLNYIPTNAAALEQNVYQDVCNGFR

SEQ ID NO: 100 - DNA, 1348 bp, Trichoderma koningii
  sig_peptide (1)..(51)
  exon (1)..(175)
  Intron (176)..(233)
  exon (234)..(1348)
atgcgatactctattgttgccccggctcttctggccggcactgcctatgcttggcttcctcaggagcgggatctggctgccttcaaccagactgctcgctttgagcaactcggcaagcgattcgagcctacgctggcttctggcgtcaccaagatcagaggtgtcaactttggtggtaagttcacatacgagcaatttctataatgcgataagccacttacatggaggtttaggctggcttatctgtgagccatggatgatgtccaacgagtggaacaatgtgatgggctgcaacaacgctgcatctgagttcgactgcatgcgcaacaactatatgggcaacaaccgtgcagcgggtaacgcaaagttcaagactcactggagcagctggatcactcccgataccgttcaatcggttcacgatgtcggcctgaacaccatccgaatccccattggctactggtcctacacggccattgtcgacaccgccagtgagccatttgctgatggtgatgccatgctcccatacctcgatgcggtcgttcagaaggccgctgatttgggaatctatgtcatcattgatctccacggcgcccccggtggtcagcagcaagacgccttcaccggccagaaccccaaccctgccggcttcttcaactcatacgactttggccgtgccgagaagtggctctcatggatgaccaaccgcatccataccaacccggcctactccaccgtcggtatgatcgaggttctcaacgagcctgtttccaaccacgatgccaacggccgctaccctgcccctggtgaaaacccgggcttgacgcagacctactaccctgccgcactccaggctgtccgttctgccgagtctgccttgaacgttcccagcaacaagaagctgcatgtgcagttcatgtccagcaagtggggctctggcgaccctcgctccaactctgctgttgccgccgactccatgactggattcgacgaccacaactacattggctttgctgtcagcaacaacggcgaccaatactcgctcatgcacagcgcctgcaccgactctcgcgtcgtcagtggccagaactttgagatcaccggtgaatggagcatgacctccggcgttgattggcaagaccaagccttcttcaccaagttctggaccgcccagcagcagctttacgagtcccccggaatggacggatggatctactggacctggaagactgagctgaacgacccccgatggacctactcctatgctacctacctcaactacatccctaccaacgctgctgccttggaacagaatgtttaccaggatgtctgcaacggattcaggtaa

SEQ ID NO: 101 - protein, 429 aa, Trichoderma koningii
  sig_peptide (1)..(17)
MRYSIVAPALLAGTAYAWLPQERDLAAFNQTARFEQLGKRFEPTLASGVTKIRGVNFGGWLICEPWMMSNEWNNVMGCNNAASEFDCMRNNYMGNNRAAGNAKFKTHWSSWITPDTVQSVHDVGLNTIRIPIGYWSYTAIVDTASEPFADGDAMLPYLDAVVQKAADLGIYVIIDLHGAPGGQQQDAFTGQNPNPAGFFNSYDFGRAEKWLSWMTNRIHTNPAYSTVGMIEVLNEPVSNHDANGRYPAPGENPGLTQTYYPAALQAVRSAESALNVPSNKKLHVQFMSSKWGSGDPRSNSAVAADSMTGFDDHNYIGFAVSNNGDQYSLMHSACTDSRVVSGQNFEITGEWSMTSGVDWQDQAFFTKFWTAQQQLYESPGMDGWIYWTWKTELNDPRWTYSYATYLNYIPTNAAALEQNVYQDVCNGFR

SEQ ID NO: 102 - protein, 412 aa, Trichoderma koningii
WLPQERDLAAFNQTARFEQLGKRFEPTLASGVTKIRGVNFGGWLICEPWMMSNEWNNVMGCNNAASEFDCMRNNYMGNNRAAGNAKFKTHWSSWITPDTVQSVHDVGLNTIRIPIGYWSYTAIVDTASEPFADGDAMLPYLDAVVQKAADLGIYVIIDLHGAPGGQQQDAFTGQNPNPAGFFNSYDFGRAEKWLSWMTNRIHTNPAYSTVGMIEVLNEPVSNHDANGRYPAPGENPGLTQTYYPAALQAVRSAESALNVPSNKKLHVQFMSSKWGSGDPRSNSAVAADSMTGFDDHNYIGFAVSNNGDQYSLMHSACTDSRVVSGQNFEITGEWSMTSGVDWQDQAFFTKFWTAQQQLYESPGMDGWIYWTWKTELNDPRWTYSYATYLNYIPTNAAALEQNVYQDVCNGFR

SEQ ID NO: 103 - DNA, 1851 bp, Trichoderma sinuosum
  sig_peptide (1)..(51)
  exon (1)..(175)
  Intron (176)..(236)
  exon (237)..(1351)
atgcgatattccatcgttgccccggctcttcttgccggcaccgcctttgcgtggcttccccaagaccgcgacttggctgccttcaaccagaccgctcgctttgagcaactcggcaagcgtttcgagccttcactcgcttctggcatcacgaagatccgcggtgtcaactttggtggtaagttgctatccaattagctccagacaactaagaaatcatctctaacgcatcgacctaggatggcttatttgcgagccttggatgatgtccaatgagtggaacaatgtcatgggttgcaacaacgccgcctctgagttcgactgcatgcttcaaaactatatgggcaacaatcgtgcgctcggaaaccagaagttccagaaccactggagagactggatcaaccctgccaccgttcagtccgttcatgatgtcggcttaaacactatccgtatccccattggctattggtcctacacggccattgtggacacatccagcgagccgtttgccgatggtgatcttatgctcccgtatcttgacgcggttgtccagaaggccgctgatctcggcatctatgtcatcatcgatcttcacggcgcccctggcggtcagcagcaggacgtctttaccggccagaatcccaacccggcaggcttcttcaactcatatgactacggtcgtgccgagaagtggttgtcttggatgacaaaccgtattcataccaaccctgcttattcaagcgtcggtatgattgaggttctcaatgagcctgtctcccagcacgatgcgaaccaccgctaccctgcccctggcgaagacacaagtctggtgcagacctactacccaggcgccctcaaggctgtccgcgatgctgaagccgcattgaacgttcccagcaacaagaagctgcacgtacagttcatgtccagcaagtggctttctggggatgctcgcaccaacgcagcagttgcaaacgaccccatgaccggatttgacgaccacaactacattggttttgcactcggaagcaccagcgaccaatactcgctgatgcacagtgcatgcactgactctcgtgtcgtgaacggccagaacttcgaaatcacgggcgagtggagcatgacttctggtgttgattggcacgacgggggctttttcacaaagttcttcacagctcagcagcagctgtatgaatcccccgggatggacggatggatctactggacttggaagaccgagttgaacgacccacgatggacctactcttatgctacctatctcaactatatcccaactaatgccgctgccctcgagcagaacgtctaccaggatgtttgcgcttcttacaggtaaacaacaagccatcattcgagtgctagcatagctcgatgactacttcgtatttatatattaattccttggatataatgagtttatacttgaacacccctttgttagtctaaaaatacatatcatgtcttcttattgcattgcactctagcatcgtaacgtcagtaccatatgctcaagcttcatgaattcgaagatggagcaaatctttaattctagcaatatgaaaggaaaagaattcattcatttatttcggaatgactctgataccttcgtcaggttcaaatcgtttctttgacctcattctcattgtgtgatcatcaggctaagatacaatacatacaactcattgaccacttcgtgtagatagattgcttgcttatcagcattcaaaacgcaatctggttaccttttgcctcttagatcgcagatacgaaatgaactcaaatttgccaatatagcctcctttattttgattcaaacgttggggtatgcactttgca

SEQ ID NO: 104 - protein, 429 aa, Trichoderma sinuosum
  sig_peptide (1)..(17)
MRYSIVAPALLAGTAFAWLPQDRDLAAFNQTARFEQLGKRFEPSLASGITKIRGVNFGGWLICEPWMMSNEWNNVMGCNNAASEFDCMLQNYMGNNRALGNQKFQNHWRDWINPATVQSVHDVGLNTIRIPIGYWSYTAIVDTSSEPFADGDLMLPYLDAVVQKAADLGIYVIIDLHGAPGGQQQDVFTGQNPNPAGFFNSYDYGRAEKWLSWMTNRIHTNPAYSSVGMIEVLNEPVSQHDANHRYPAPGEDTSLVQTYYPGALKAVRDAEAALNVPSNKKLHVQFMSSKWLSGDARTNAAVANDPMTGFDDHNYIGFALGSTSDQYSLMHSACTDSRVVNGQNFEITGEWSMTSGVDWHDGGFFTKFFTAQQQLYESPGMDGWIYWTWKTELNDPRWTYSYATYLNYIPTNAAALEQNVYQDVCASYR

SEQ ID NO: 105 - protein, 412 aa, Trichoderma sinuosum
WLPQDRDLAAFNQTARFEQLGKRFEPSLASGITKIRGVNFGGWLICEPWMMSNEWNNVMGCNNAASEFDCMLQNYMGNNRALGNQKFQNHWRDWINPATVQSVHDVGLNTIRIPIGYWSYTAIVDTSSEPFADGDLMLPYLDAVVQKAADLGIYVIIDLHGAPGGQQQDVFTGQNPNPAGFFNSYDYGRAEKWLSWMTNRIHTNPAYSSVGMIEVLNEPVSQHDANHRYPAPGEDTSLVQTYYPGALKAVRDAEAALNVPSNKKLHVQFMSSKWLSGDARTNAAVANDPMTGFDDHNYIGFALGSTSDQYSLMHSACTDSRVVNGQNFEITGEWSMTSGVDWHDGGFFTKFFTAQQQLYESPGMDGWIYWTWKTELNDPRWTYSYATYLNYIPTNAAALEQNVYQDVCASYR

SEQ ID NO: 106 - DNA, 2391 bp, Trichoderma harzianum
  sig_peptide (1)..(51)
  sig_peptide (1)..(51)
  exon (1)..(294)
  misc_feature (54)..(132): Propeptide region
  Intron (295)..(348)
  exon (349)..(2164)
  Intron (2165)..(2218)
  exon (2219)..(2391)
atgttgaagctcacggcgctcgttgcgctcttgctgggcgcggcgtctgctacgccgactcctagccctcctgccagcgatgagggcatcacaaagcgtgccaccagcttctattaccccaacatggaccatgtcaatgcgcccaggggtttcgctcctgacctggatggcgacttcaactacccaatctatcagactgtcaacgcaggagatggaaatgctctccagaatgctatcaccactgatggaaagggtggctctcgtcacccacagtggtttgcttcacagccacgagtatgactttgatgtaaattcttgtacaaacgggtatctaacgttagtgtccaggttgtttacattcccccgggaacatatactatctccaagactctgagattcaacactgataccattttaatgggtgacccaactaatcctcccattattaaggctgctgccggtttctcgggcgatcagactcttatcagtgctcaagacccctccaccaacgagaagggagagctttctttcgccgtagctattaagaacgtggtattggacactacggctataccaggtggaaattcatttactgccctatggtggggtgttgctcaagctgcgcatctgcagaatgtacgcattactatgagttcctcttcgggtggaaacggccataccggcatccggatgggtcgcggctcaacactcggcctcgccgacgttcgcgttgaacgcggccagaacggtatttggattgatggccatcaacaagccagcttccacaacatttacttttttcaaaatacgatcggcatgctcatcagcggcggcaataccttcagcattttctcgtcgaccttcgacacctgtggaaccggcatttccaacactggcggttcaccctggattgccctgattgatgcaaagtcaatcaactctggtgttacctttacaactaatcagtttccttcatttatgattgagaatctgactaaagataatggcacacctgttgttgttgtccgaggctcaactttggttggcgcttctagccatgtcaacacttactcttacggcaacaccgtgggcagaaaccctacttacggcgatgttacatctagtaacactagacctggtgctcttgctcctggtggtcgttacccttatgtggctccccctacttatggagatctgcccatctcgagcttcctcaacgtcaaggatccagcgcagaacggcgggaggacggtcaaaggagataacacgatcgatgaggcagccacgctcaatgccatcctggaacttgcagcaagccagaataaggttgcttattttccttttggcaagtaccgggtggattccactctttttatccctaagggttcccgcatcgtgggtgaggcttgggccaccatcaccggcaacggcaactttttcaagaacgaaaacagcccacaacccgttgtctcagttggtcgtgcaggcgatgttggaattgcacagattcaagacatgcgttttaccgttaatgacgttctttcaggagccatcgtcgttcagttcaatatggctggcaacaaccctggtgatgttgctctttggaactctttggtcaccgttggtggcacacgaggtgcttcagctttggctaatgcttgtaccaacaatagcaatgaatgtaagggtgctttcattggtatccacgtggcgaagggatcatctccttacatccaaaacgtttggaactgggttgcggatcacatcgctgagaacttcagtggcggcacttcaattgctggtaaaggcggaattttggtgcagtctacgaaggcaacctggctttatgcgataggaagtgagcattggtggttgtatcaactcaatcttcacaatgccgccaacgttgttgtgtctctgctccaggcggagaccaactaccaccaaggcgccaacacgcagcagattcctcccgccccctgggttgcaaatattggtacttggggcgatcctgatttcgcttggtgcaacggtggtgataaaagatgccgtatgggccctgcaaacttcatcaacggaggttccaacatctacacatatgcctccgcggcatgggcgttcttcagcggccctggccagggctgcgctcaattcgaatgtcaacgtaagctctgatatctctttcatttcttagaatatgactaacattgaataacagaaaccatgcactggattgccagcacccccagcaaccttcaggcttttggactctgctccaaggattccgtcaacacactgcgtctgggtgatggcacattcatcaacacccagaatggatacactggcggctggactcctggcggtggtgatgttggccgttatactacttaa

SEQ ID NO: 107 - protein, 760 aa, Trichoderma harzianum
  sig_peptide (1)..(17)
  misc_feature (18)..(33): Propeptide region
MLKLTALVALLLGAASATPTPSPPASDEGITKRATSFYYPNMDHVNAPRGFAPDLDGDFNYPIYQTVNAGDGNALQNAITTDGKGGSRHPQWFASQPRVVYIPPGTYTISKTLRFNTDTILMGDPTNPPIIKAAAGFSGDQTLISAQDPSTNEKGELSFAVAIKNVVLDTTAIPGGNSFTALWWGVAQAAHLQNVRITMSSSSGGNGHTGIRMGRGSTLGLADVRVERGQNGIWIDGHQQASFHNIYFFQNTIGMLISGGNTFSIFSSTFDTCGTGISNTGGSPWIALIDAKSINSGVTFTTNQFPSFMIENLTKDNGTPVVVVRGSTLVGASSHVNTYSYGNTVGRNPTYGDVTSSNTRPGALAPGGRYPYVAPPTYGDLPISSFLNVKDPAQNGGRTVKGDNTIDEAATLNAILELAASQNKVAYFPFGKYRVDSTLFIPKGSRIVGEAWATITGNGNFFKNENSPQPVVSVGRAGDVGIAQIQDMRFTVNDVLSGAIVVQFNMAGNNPGDVALWNSLVTVGGTRGASALANACTNNSNECKGAFIGIHVAKGSSPYIQNVWNWVADHIAENFSGGTSIAGKGGILVQSTKATWLYAIGSEHWWLYQLNLHNAANVVVSLLQAETNYHQGANTQQIPPAPWVANIGTWGDPDFAWCNGGDKRCRMGPANFINGGSNIYTYASAAWAFFSGPGQGCAQFECQQTMHWIASTPSNLQAFGLCSKDSVNTLRLGDGTFINTQNGYTGGWTPGGGDVGRYTT

SEQ ID NO: 108 - protein, 727 aa, Trichoderma harzianum
ATSFYYPNMDHVNAPRGFAPDLDGDFNYPIYQTVNAGDGNALQNAITTDGKGGSRHPQWFASQPRVVYIPPGTYTISKTLRFNTDTILMGDPTNPPIIKAAAGFSGDQTLISAQDPSTNEKGELSFAVAIKNVVLDTTAIPGGNSFTALWWGVAQAAHLQNVRITMSSSSGGNGHTGIRMGRGSTLGLADVRVERGQNGIWIDGHQQASFHNIYFFQNTIGMLISGGNTFSIFSSTFDTCGTGISNTGGSPWIALIDAKSINSGVTFTTNQFPSFMIENLTKDNGTPVVVVRGSTLVGASSHVNTYSYGNTVGRNPTYGDVTSSNTRPGALAPGGRYPYVAPPTYGDLPISSFLNVKDPAQNGGRTVKGDNTIDEAATLNAILELAASQNKVAYFPFGKYRVDSTLFIPKGSRIVGEAWATITGNGNFFKNENSPQPVVSVGRAGDVGIAQIQDMRFTVNDVLSGAIVVQFNMAGNNPGDVALWNSLVTVGGTRGASALANACTNNSNECKGAFIGIHVAKGSSPYIQNVWNWVADHIAENFSGGTSIAGKGGILVQSTKATWLYAIGSEHWWLYQLNLHNAANVVVSLLQAETNYHQGANTQQIPPAPWVANIGTWGDPDFAWCNGGDKRCRMGPANFINGGSNIYTYASAAWAFFSGPGQGCAQFECQQTMHWIASTPSNLQAFGLCSKDSVNTLRLGDGTFINTQNGYTGGWTPGGGDVGRYTT

SEQ ID NO: 109 - DNA, 2324 bp, Trichoderma atroviride
  sig_peptide (1)..(57)
  exon (1)..(2101): Propeptide region
  Intron (2102)..(2154): Propeptide region
  exon (2155)..(2324): Propeptide region
atgaagtctctcaccgctgtggtggccttcctgggcgccgtgacagcctcgccagcacttgtccgccatcatggccgctctgctctccagcctcgagcaaacagctccttctggtatgctgctatggaccacaccggccaattcaagggctccgctccctatgtagatgcttcctacaacgtgtttgttgccgtcagccctggtgacgccggctctcttcagaatgccatcgactcagctggtaacggcaaccgacagaatgagtggctagcatcgcagcctcgtgttgtgtatatcccatcgggaacatacgagctctcaagcaccctcaacatgcgtaccgatactatcctgttcggtgacgctaccaaccctcccgttatcaaggccgcggcaggattcagcgacagttacctcgtcaacggccaggatccctctacgggcgatgccggcgaactttcctttgctgttggactgaagaatgttgttctggacaccactgctgttgatggaagctccagcatctctgctctctactggggtgttgctcaggcttgtcagctgcaaaacgtcaagatcacgcttgcgccctcggtcaacggcaagggccacactggagtccagctgggccgtggatctactcttgcactggccgatatccgcattgagaatggccagacgggtatctggcacaacggccaccaacaggccctctacaagagcatctacttttacaagaacaccgtcggtatgctcatcagcggcggcaacaccatcagcctgttgaaccctacctttgacagcgttggcactggcgtttccaacaccggcggcagcccctttatcggaatcgtcgatgccacgtccatcaactcgggcgtcacgttcacaaccagcgtctatccttccattgtcattgacaacttgaccaaggacaccgactctgacgttgctgtgatccgcggcacaacaactgtcggcgcctcgaagaacgtcgtcaactacagctacggaaacacggttggggcgaaccccgtctacggcggtgtcaacggcaacacgactcgccccagcggcgttgcccctggtggccgtatcccagccgtcgccgtgcccaactatgcaaacaaccatgtcacggactttgtcaacgtcaaggaccccagccagaatggcggccagaccgtcaagggcgatggcagcaccgacgactctgctgccctcaacaaagtcctccagttcgccgccaccaacaacaagattgcctacttcccctttggcgactaccgtgttgagtctacgctcctggtccccgtcggctctcagctggtcggcgaggcctgggcaacgatttccggtggcggtgacttcttcaaggactcgtccagccccaagcccgttgtccaggtcggcaacgaaggcgacgtcggcgtggcccagatccaggacttccgcttcaccgtctccgacgtgctgcccggcgccatcattgtgcagttcaacgctgccggctccaagcccggcgacgtggcgctcttcaactccctcgtcaccgtcggcggaacccacggcgccgatgcgctgaccaacgcctgcaccgacgccagcaacgaatgccaggctgcctttatcggcctgcacttcaccgagagctcgtccgcctacgtggagaacacctggaactgggttgccgaccacatcaccgagggcttcagcggcggatccaacattgccgcaaagggcggcgccctggtcgagtccaccaagggcacctggctcaacggcctgggcagcgagcactggtggctgtaccagctcaacctcaagtctgccagcaacgtcgccgtgactctgctgcagagcgagaccaactacgaccagggcgacaacaccaagcaggtccctcctgcgccctggaccgccgatgtccagggctggggcgacccggacttctcctggtgcgacagcactgcccgctgccacatgggcctcgccaactatgtcaacggcggctctgacatttactactacggttctgcctcgtgggcctttttcagtggtcccggataccagggctgcgctggttcctatcagtgccaaggtacgtttataacgaagacaatttccaagttgcaattcactgacattaagcagactacatgcacttcatctcggcgacgcctacgaacctccagatgtacggcatgtgctccaaggacacctccgttgctctccgcctgggtgacggcaccaagatcaatgcccagcctgactttaccggaggctggagccctggtgcagacattggtcgctacacctcttag

SEQ ID NO: 110 - protein, 756 aa, Trichoderma atroviride
  sig_peptide (1)..(19)
  misc_feature (20)..(33): Propeptide region
MKSLTAVVAFLGAVTASPALVRHHGRSALQPRANSSFWYAAMDHTGQFKGSAPYVDASYNVFVAVSPGDAGSLQNAIDSAGNGNRQNEWLASQPRVVYIPSGTYELSSTLNMRTDTILFGDATNPPVIKAAAGFSDSYLVNGQDPSTGDAGELSFAVGLKNVVLDTTAVDGSSSISALYWGVAQACQLQNVKITLAPSVNGKGHTGVQLGRGSTLALADIRIENGQTGIWHNGHQQALYKSIYFYKNTVGMLISGGNTISLLNPTFDSVGTGVSNTGGSPFIGIVDATSINSGVTFTTSVYPSIVIDNLTKDTDSDVAVIRGTTTVGASKNVVNYSYGNTVGANPVYGGVNGNTTRPSGVAPGGRIPAVAVPNYANNHVTDFVNVKDPSQNGGQTVKGDGSTDDSAALNKVLQFAATNNKIAYFPFGDYRVESTLLVPVGSQLVGEAWATISGGGDFFKDSSSPKPVVQVGNEGDVGVAQIQDFRFTVSDVLPGAIIVQFNAAGSKPGDVALFNSLVTVGGTHGADALTNACTDASNECQAAFIGLHFTESSSAYVENTWNWVADHITEGFSGGSNIAAKGGALVESTKGTWLNGLGSEHWWLYQLNLKSASNVAVTLLQSETNYDQGDNTKQVPPAPWTADVQGWGDPDFSWCDSTARCHMGLANYVNGGSDIYYYGSASWAFFSGPGYQGCAGSYQCQDYMHFISATPTNLQMYGMCSKDTSVALRLGDGTKINAQPDFTGGWSPGADIGRYTS

SEQ ID NO: 111 - protein, 723 aa, Trichoderma atroviride
NSSFWYAAMDHTGQFKGSAPYVDASYNVFVAVSPGDAGSLQNAIDSAGNGNRQNEWLASQPRVVYIPSGTYELSSTLNMRTDTILFGDATNPPVIKAAAGFSDSYLVNGQDPSTGDAGELSFAVGLKNVVLDTTAVDGSSSISALYWGVAQACQLQNVKITLAPSVNGKGHTGVQLGRGSTLALADIRIENGQTGIWHNGHQQALYKSIYFYKNTVGMLISGGNTISLLNPTFDSVGTGVSNTGGSPFIGIVDATSINSGVTFTTSVYPSIVIDNLTKDTDSDVAVIRGTTTVGASKNVVNYSYGNTVGANPVYGGVNGNTTRPSGVAPGGRIPAVAVPNYANNHVTDFVNVKDPSQNGGQTVKGDGSTDDSAALNKVLQFAATNNKIAYFPFGDYRVESTLLVPVGSQLVGEAWATISGGGDFFKDSSSPKPVVQVGNEGDVGVAQIQDFRFTVSDVLPGAIIVQFNAAGSKPGDVALFNSLVTVGGTHGADALTNACTDASNECQAAFIGLHFTESSSAYVENTWNWVADHITEGFSGGSNIAAKGGALVESTKGTWLNGLGSEHWWLYQLNLKSASNVAVTLLQSETNYDQGDNTKQVPPAPWTADVQGWGDPDFSWCDSTARCHMGLANYVNGGSDIYYYGSASWAFFSGPGYQGCAGSYQCQDYMHFISATPTNLQMYGMCSKDTSVALRLGDGTKINAQPDFTGGWSPGADIGRYTS

SEQ ID NO: 112 - DNA, 2337 bp, Simplicillium lamellicola
  sig_peptide (1)..(66)
  CDS (1)..(2337): Propeptide region
atgggactcaccaagcttttcacggccgccttgatggcccttcaggccattgagcctgtttctgctgctcctcagcaatccctcaacgttcgcaccaatgaggtccgcgccgactccaactggtggttctccaagatccaacgccagggtaccgttgcctattccaacaacaagttcaaggttttccgtaatgtcaaggattacggtgccaagggtgatggtagttccgatgacaccgaggctatcaaccgcgccatcactgatggtggtcgatgtggccagggctgcgactccagcaccaccactcccggtctcgtctacttccctcccggtacctacgttgtttccaagcccatcgttcagctctactacactcagctcgttggtgatgccgccagcgtccccaccatcaaggctgcctccaactttgctggcattgctgtcattgactctgacccctacgacgacactggcaacaactggtacactaaccagaacaacttcttccgccagatccgcaacttcaagattgaccttactggtctccccaagactactggtaccggtatccactggcaggttgcccaggccacctctctccagaacattgagttcaacatgatcaaggacaagagcgccgacaacaagcagcagggtatcttcatggacaacggctctggtggtttcatgactgaccttaccttcaacggtggttccctcggtatgttcctcggcaaccagcagttcaccacccgcaacctcaagttcaacagctgcaacactgccatctacatgaactggaactggctctggacgttccagggtgttcagattgacgatgccaagattggtatcaacatggccaacaagggtgacggtgtccagactgtcggctctgttgtccttctcgacagctccatctccaatactgccgttggtgtcactactgcctacagcacttctcagaatggcacttacggaagcctggtcctcgacaatgtcgatttcagcaagaacacccctgttgctatccagaacggcgacagcaaggacactattctcgacggtaacgctgttgtccagaactgggttcagggacgtgcctaccagggcactaacggcaaggctgtccagggtgcccagagtgccgtcaacaagcccggctctctccttgatggtggcaagattgtcactcactccaagccccagtacaacgatgtggatgcctccaagtttgtctctgtcaagtccaagggcgccaagggtgatggtgttaccgatgataccaaggctatccaggccgtcttcaacagcattggtggcgaccagattgtctactttgaccacggtgcctacgtcattaccgacactgttcaggtccccaagaacgtcaaggttgttggtgagatctggcccctcatcatggctggtggcgactctgccttcaaggaccaggccaaccccaagcccgtcttccgtgtcggtcagcccggtgacgttggtaccgttgagatgcaggacatcatcttccagactctgggtcctcagccgggtgctatcctcatggagtttaacgttgctggtcagtccaagggtgctgccgctctctgggatgtccacttccgcgttggtggttctgccggcactcagctccagtccgacaagtgcagcaagaacccatcagtcactgctccccccaaccccgagtgcattggtgcctttgctcttattcacttgactccttcctccagcgcctacatcgagaactgctggttctgggttgccgaccacgagcttgaccgttctgaccacaaccaaatcaacctctacaacggtcgtggtgtcattattgagagtaccaagggaacttggttgtggggcacttcctctgagcacaacgttctttccaactaccagctcaccaaggctaagggtgtctttatgggcttgatccagactgagactgcttacatgcagggcaaccccgacgccaaggtccccttcaagtacaacgccaagtacggtgaccctgacttctccaagtgcagtggaggtaagtgcgctcgcacctggggtctccgtgtcattgactccagcgatgtccttgtctatggtggtggcttgtacagcttcttcgacaactacgaccagaagtgtgtcgatgccaacaactgccaggacaacatgattgatatccagaactcccagaacctcaacatgtttggtatcagcaccaaggcttccatcaacatgttcaccatcaacggtgcctctggcgctcaggacaaggataaccgcaacaacttctgcgctgctgtggccctcttccgcccatag

SEQ ID NO: 113 - protein, 778 aa, Simplicillium lamellicola
MGLTKLFTAALMALQAIEPVSAAPQQSLNVRTNEVRADSNWWFSKIQRQGTVAYSNNKFKVFRNVKDYGAKGDGSSDDTEAINRAITDGGRCGQGCDSSTTTPGLVYFPPGTYVVSKPIVQLYYTQLVGDAASVPTIKAASNFAGIAVIDSDPYDDTGNNWYTNQNNFFRQIRNFKIDLTGLPKTTGTGIHWQVAQATSLQNIEFNMIKDKSADNKQQGIFMDNGSGGFMTDLTFNGGSLGMFLGNQQFTTRNLKFNSCNTAIYMNWNWLWTFQGVQIDDAKIGINMANKGDGVQTVGSVVLLDSSISNTAVGVTTAYSTSQNGTYGSLVLDNVDFSKNTPVAIQNGDSKDTILDGNAVVQNWVQGRAYQGTNGKAVQGAQSAVNKPGSLLDGGKIVTHSKPQYNDVDASKFVSVKSKGAKGDGVTDDTKAIQAVFNSIGGDQIVYFDHGAYVITDTVQVPKNVKVVGEIWPLIMAGGDSAFKDQANPKPVFRVGQPGDVGTVEMQDIIFQTLGPQPGAILMEFNVAGQSKGAAALWDVHFRVGGSAGTQLQSDKCSKNPSVTAPPNPECIGAFALIHLTPSSSAYIENCWFWVADHELDRSDHNQINLYNGRGVIIESTKGTWLWGTSSEHNVLSNYQLTKAKGVFMGLIQTETAYMQGNPDAKVPFKYNAKYGDPDFSKCSGGKCARTWGLRVIDSSDVLVYGGGLYSFFDNYDQKCVDANNCQDNMIDIQNSQNLNMFGISTKASINMFTINGASGAQDKDNRNNFCAAVALFRP

SEQ ID NO: 114 - protein, 739 aa, Simplicillium lamellicola
NWWFSKIQRQGTVAYSNNKFKVFRNVKDYGAKGDGSSDDTEAINRAITDGGRCGQGCDSSTTTPGLVYFPPGTYVVSKPIVQLYYTQLVGDAASVPTIKAASNFAGIAVIDSDPYDDTGNNWYTNQNNFFRQIRNFKIDLTGLPKTTGTGIHWQVAQATSLQNIEFNMIKDKSADNKQQGIFMDNGSGGFMTDLTFNGGSLGMFLGNQQFTTRNLKFNSCNTAIYMNWNWLWTFQGVQIDDAKIGINMANKGDGVQTVGSVVLLDSSISNTAVGVTTAYSTSQNGTYGSLVLDNVDFSKNTPVAIQNGDSKDTILDGNAVVQNWVQGRAYQGTNGKAVQGAQSAVNKPGSLLDGGKIVTHSKPQYNDVDASKFVSVKSKGAKGDGVTDDTKAIQAVFNSIGGDQIVYFDHGAYVITDTVQVPKNVKVVGEIWPLIMAGGDSAFKDQANPKPVFRVGQPGDVGTVEMQDIIFQTLGPQPGAILMEFNVAGQSKGAAALWDVHFRVGGSAGTQLQSDKCSKNPSVTAPPNPECIGAFALIHLTPSSSAYIENCWFWVADHELDRSDHNQINLYNGRGVIIESTKGTWLWGTSSEHNVLSNYQLTKAKGVFMGLIQTETAYMQGNPDAKVPFKYNAKYGDPDFSKCSGGKCARTWGLRVIDSSDVLVYGGGLYSFFDNYDQKCVDANNCQDNMIDIQNSQNLNMFGISTKASINMFTINGASGAQDKDNRNNFCAAVALFRP

SEQ ID NO: 115 - DNA, 2324 bp, Trichoderma atroviride
  sig_peptide (1)..(48)
  exon (1)..(2101)
  Intron (2102)..(2154)
  exon (2155)..(2324)
atgaagtctctcaccgctgtggtggccttgctaggcgccgtggcagcctcgccagcagtcgtccgccatcatggccgctctgctctccagcctcgagcaaacagctccttttggtatgctgccatggaccacaccggccagttcaagggctctgctccttatgtagatgcttcctacaacgtctttgttgccgtcagccctggtgacgccggctctcttcagaatgccatcgactcagctggtagcggcaaccgacagaatgagtggctggcatcgcagcctcgtgtcgtgtacatcccgtcgggaacatacgagctctcaagcaccctcaacatgcgtaccgacactatcctgttcggtgacgccaccaaccctcccgttatcaaggccgcggcaggattcagcgacaattacctcgtcaacggccaggatccctctacgggcgatgccggtgaactttcctttgctgttggactgaagaatgttgttctggacaccactgctgttgatggaagctccagcatctctgctctctactggggtgttgctcaggcttgtcagctacaaaacgtcaagatcacgcttgcgccctcggtcaacggcaagggccacactggtgtccagctgggccgtggatctactcttgcactcgccgacatccgcattgagaatggccagacgggtatctggcacaacggccaccagcaggccctctacaagagcatctacttttacaagaacactgtcggcatgctcatcagcggcggcaacaccatcagcttgttgaaccctacctttgacagcgttggcactggtgtttccaacaccggcggcagcccctttatcggaatcgtcgatgccacgtccatcaactcgggcgtcaccttcacaaccagcgtctatccttccattgtcattgacaacttgaccaaggacaccgactctgacgttgccgtgatccgcggcacaacgactgtcggcgcctcaaagaacgtcgtcaactacagctacggaaacacggttggagcgaaccccgtctacggcggtgtcaacggcaacacgactcgccccagcggcgttgcccccggtggccgtatcccagccgtcgccgtgcccaactatgcaaacaatcctgttaccgactttgtcaacgtcaaggaccccagccagaacggcggccagaccgtcaagggcgatggcagcaccgacgactctgccgccctcaacaaagtcctccaattcgccgccaccaacaacaagattgcctacttcccctttggcgactaccgtgttgagtctacgctcctggtccccgttggctcccagctggttggcgaggcctgggcaactatttccggcggcggcgacttcttcaaggacgcatccagccccaagcccgtagtccaggtcggcaacgagggcgacgtcggcgtggcccagatccaggacttccgcttcaccgtctccgacgtcctgcccggcgccatcatcgtgcagttcaacgctgccggctccaagcccggcgacgtggcgctcttcaactccctcgtcaccgtcggcggaacccacggggccgatgcgctgaccaacgcctgcaccgacgccagcaacgagtgccaggctgcctttctcggccttcacttcaccgagggctcgtccgcctacgtggagaacacctggaactgggttgccgaccacatcaccgagggcttcagcggcggatccaacattgccgcaaagggcggcgcgctggtcgagtccaccaagggcacctggctcaacggcctgggcagcgagcactggtggctgtaccagctcaacctcaaggctgccagcaacgtcgccgtgacgctgctgcagagcgagaccaactacgaccagggcgacaacaccaagcaggtcccccctgcgccgtggaccgccgatgtccagggctggggcgatcccgacttctcctggtgcgacagcactgcccgctgccacatgggcctcgccaactatgtcaacggcggctctgacatttactactacggctctgcctcgtgggcctttttcagcggtcccggataccagggctgcgctggttcctatcagtgccaaggtacgttgatgacgaaaacagtttccaagctacaattcactgacattaagcagactacatgcacttcatctcggcgactcctacgaacctccagatgtacggaatgtgctccaaggacacctccgttgctctccgcctgggcgacggcaccaagatcaatgcccagcctgactttaccggaggttggagccctggcgcagacattggtcgctatacctcttag

SEQ ID NO: 116 - protein, 756 aa, Trichoderma atroviride
  sig_peptide (1)..(16)
  misc_feature (17)..(33): Propeptide region
MKSLTAVVALLGAVAASPAVVRHHGRSALQPRANSSFWYAAMDHTGQFKGSAPYVDASYNVFVAVSPGDAGSLQNAIDSAGSGNRQNEWLASQPRVVYIPSGTYELSSTLNMRTDTILFGDATNPPVIKAAAGFSDNYLVNGQDPSTGDAGELSFAVGLKNVVLDTTAVDGSSSISALYWGVAQACQLQNVKITLAPSVNGKGHTGVQLGRGSTLALADIRIENGQTGIWHNGHQQALYKSIYFYKNTVGMLISGGNTISLLNPTFDSVGTGVSNTGGSPFIGIVDATSINSGVTFTTSVYPSIVIDNLTKDTDSDVAVIRGTTTVGASKNVVNYSYGNTVGANPVYGGVNGNTTRPSGVAPGGRIPAVAVPNYANNPVTDFVNVKDPSQNGGQTVKGDGSTDDSAALNKVLQFAATNNKIAYFPFGDYRVESTLLVPVGSQLVGEAWATISGGGDFFKDASSPKPVVQVGNEGDVGVAQIQDFRFTVSDVLPGAIIVQFNAAGSKPGDVALFNSLVTVGGTHGADALTNACTDASNECQAAFLGLHFTEGSSAYVENTWNWVADHITEGFSGGSNIAAKGGALVESTKGTWLNGLGSEHWWLYQLNLKAASNVAVTLLQSETNYDQGDNTKQVPPAPWTADVQGWGDPDFSWCDSTARCHMGLANYVNGGSDIYYYGSASWAFFSGPGYQGCAGSYQCQDYMHFISATPTNLQMYGMCSKDTSVALRLGDGTKINAQPDFTGGWSPGADIGRYTS

SEQ ID NO: 117 - protein, 723 aa, Trichoderma atroviride
NSSFWYAAMDHTGQFKGSAPYVDASYNVFVAVSPGDAGSLQNAIDSAGSGNRQNEWLASQPRVVYIPSGTYELSSTLNMRTDTILFGDATNPPVIKAAAGFSDNYLVNGQDPSTGDAGELSFAVGLKNVVLDTTAVDGSSSISALYWGVAQACQLQNVKITLAPSVNGKGHTGVQLGRGSTLALADIRIENGQTGIWHNGHQQALYKSIYFYKNTVGMLISGGNTISLLNPTFDSVGTGVSNTGGSPFIGIVDATSINSGVTFTTSVYPSIVIDNLTKDTDSDVAVIRGTTTVGASKNVVNYSYGNTVGANPVYGGVNGNTTRPSGVAPGGRIPAVAVPNYANNPVTDFVNVKDPSQNGGQTVKGDGSTDDSAALNKVLQFAATNNKIAYFPFGDYRVESTLLVPVGSQLVGEAWATISGGGDFFKDASSPKPVVQVGNEGDVGVAQIQDFRFTVSDVLPGAIIVQFNAAGSKPGDVALFNSLVTVGGTHGADALTNACTDASNECQAAFLGLHFTEGSSAYVENTWNWVADHITEGFSGGSNIAAKGGALVESTKGTWLNGLGSEHWWLYQLNLKAASNVAVTLLQSETNYDQGDNTKQVPPAPWTADVQGWGDPDFSWCDSTARCHMGLANYVNGGSDIYYYGSASWAFFSGPGYQGCAGSYQCQDYMHFISATPTNLQMYGMCSKDTSVALRLGDGTKINAQPDFTGGWSPGADIGRYTS

SEQ ID NO: 118 - DNA, 1551 bp, Trichoderma atroviride
  sig_peptide (1)..(54)
  exon (1)..(871)
  Intron (872)..(946)
  exon (947)..(1551)
atgcgtgcctctctctttgcctctctcgccggccaggtggccatcagcgctgctctgccagagcctgctgcccacagcccccgtgcggctggtgctaccgcctatgcctccaactcgggcggtaactacaagctcagctcgattgctgctcccgtccaaggcgctggatctcccggctcagagtctacttggaacctgagcattgacgatacgagctccggttacaagcagaagatcaccggcttcggtgctgctgttaccgatgccaccgtcgcctccttcaacgagctgtctgccagcactctcagccagctgctcaacgagctcatgacgggcgctggtgctaacttcgccctcatgcgacacaccattggtgcctccgacttgtctgccgaccctgcctacacctacgacgacaatggcggcaacgctgataccggcatgactggcttcaacctcggagaccgtggtaccgccatggcccagatgctggctcagatgaagggcctcaactccaacttgaagatctttggatctccctggagccctcctgcttggatgaagctcaacaacgccattgacggcaacaccaacaacaacaacctcaacgatggctacttgaccggcaacggagctcagtactccagctcctttgcccagtactttgtcaagtacatccaggcctacgagtcccacggcgccaccatcgacgccattaccattcagaacgagcccctgaacagccagtccggctaccctaccatgtacatgttctcgtacgagcagggagacctcatccagaactacgtcggccctgcgctgaaggccgctggcctcaacacccagatttgggcttacgaccacaacaccggtatgtatctcgcacaaatcaacgtctctataacgaaagcaagcgttccttgtggctaacacaaaacccatgtagacgtgcccgatttccctgagcaggtcctgggcattgcctccgagtatgtccctgccgttgcatggcactgctacgccagcagcctggactggaccgtcttgaccaacttcaagaaccagttccccaacgtggagcagtacatgaccgagtgctggactccctccaccggctcctggaaccaggcctccagcttcaccatcggccctctccagaactgggcttccggcgttgctgcctggaccctcggcaccaccgcccaggacggccctcacctgtccgagggtggatgcgccacctgcaccggtctcgtcaccatcaacaacggccagtacaccttccagaccgcctactacatgatggcccagtacagcaagtttatgcccgtcggcgccaccgtcctcagcggcactggcagctacacctactccggcagcggtggcatccagtccgttgcctctctcaaccctgacggtacccgcacggtcgtcattgagaacacctttggcaacgacatctacattcacctgactacccagagcggccaggagtggagcggcaatgttcccaccgagtctgtcaccacttgggtcctccctgctgtttaa

SEQ ID NO: 119 - protein, 491 aa, Trichoderma atroviride
  sig_peptide (1)..(18)
  misc_feature (19)..(76): Propeptide region
MRASLFASLAGQVAISAALPEPAAHSPRAAGATAYASNSGGNYKLSSIAAPVQGAGSPGSESTWNLSIDDTSSGYKQKITGFGAAVTDATVASFNELSASTLSQLLNELMTGAGANFALMRHTIGASDLSADPAYTYDDNGGNADTGMTGFNLGDRGTAMAQMLAQMKGLNSNLKIFGSPWSPPAWMKLNNAIDGNTNNNNLNDGYLTGNGAQYSSSFAQYFVKYIQAYESHGATIDAITIQNEPLNSQSGYPTMYMFSYEQGDLIQNYVGPALKAAGLNTQIWAYDHNTDVPDFPEQVLGIASEYVPAVAWHCYASSLDWTVLTNFKNQFPNVEQYMTECWTPSTGSWNQASSFTIGPLQNWASGVAAWTLGTTAQDGPHLSEGGCATCTGLVTINNGQYTFQTAYYMMAQYSKFMPVGATVLSGTGSYTYSGSGGIQSVASLNPDGTRTVVIENTFGNDIYIHLTTQSGQEWSGNVPTESVTTWVLPAV

SEQ ID NO: 120 - protein, 415 aa, Trichoderma atroviride
QKITGFGAAVTDATVASFNELSASTLSQLLNELMTGAGANFALMRHTIGASDLSADPAYTYDDNGGNADTGMTGFNLGDRGTAMAQMLAQMKGLNSNLKIFGSPWSPPAWMKLNNAIDGNTNNNNLNDGYLTGNGAQYSSSFAQYFVKYIQAYESHGATIDAITIQNEPLNSQSGYPTMYMFSYEQGDLIQNYVGPALKAAGLNTQIWAYDHNTDVPDFPEQVLGIASEYVPAVAWHCYASSLDWTVLTNFKNQFPNVEQYMTECWTPSTGSWNQASSFTIGPLQNWASGVAAWTLGTTAQDGPHLSEGGCATCTGLVTINNGQYTFQTAYYMMAQYSKFMPVGATVLSGTGSYTYSGSGGIQSVASLNPDGTRTVVIENTFGNDIYIHLTTQSGQEWSGNVPTESVTTWVLPAV

SEQ ID NO: 121 - protein, 253 aa, Penicillium emersonii
MLSSTTRTLAFTGLAGLLSAPLVKAHGFVQGIVIGDQFYSGYIVNSFPYESNPPPVIGWATTATDLGFVDGTGYQGPDIICHRNATPAPLTAPVAAGGTVELQWTPWPDSHHGPVITYLAPCNGNCSTVDKTTLEFFKIDQQGLIDDTSPPGTWASDNLIANNNSWTVTIPNSVAPGNYVLRHEIIALHSANNKDGAQNYPQCINIEVTGGGSDAPEGTLGEDLYHDTDPGILVDIYEPIATYTIPGPPEPTF

SEQ ID NO: 122 - protein, 863 aa, Aspergillus fumigatus
MRFGWLEVAALTAASVANAQELAFSPPFYPSPWADGQGEWADAHRRAVEIVSQMTLAEKVNLTTGTGWEMDRCVGQTGSVPRLGINWGLCGQDSPLGIRFSDLNSAFPAGTNVAATWDKTLAYLRGKAMGEEFNDKGVDILLGPAAGPLGKYPDGGRIWEGFSPDPVLTGVLFAETIKGIQDAGVIATAKHYILNEQEHFRQVGEAQGYGYNITETISSNVDDKTMHELYLWPFADAVRAGVGAVMCSYNQINNSYGCQNSQTLNKLLKAELGFQGFVMSDWSAHHSGVGAALAGLDMSMPGDISFDDGLSFWGTNLTVSVLNGTVPAWRVDDMAVRIMTAYYKVGRDRLRIPPNFSSWTRDEYGWEHSAVSEGAWTKVNDFVNVQRSHSQIIREIGAASTVLLKNTGALPLTGKEVKVGVLGEDAGSNPWGANGCPDRGCDNGTLAMAWGSGTANFPYLVTPEQAIQREVISNGGNVFAVTDNGALSQMADVASQSSVSLVFVNADSGEGFISVDGNEGDRKNLTLWKNGEAVIDTVVSHCNNTIVVIHSVGPVLIDRWYDNPNVTAIIWAGLPGQESGNSLVDVLYGRVNPSAKTPFTWGKTRESYGAPLLTEPNNGNGAPQDDFNEGVFIDYRHFDKRNETPIYEFGHGLSYTTFGYSHLRVQALNSSSSAYVPTSGETKPAPTYGEIGSAADYLYPEGLKRITKFIYPWLNSTDLEDSSDDPNYGWEDSEYIPEGARDGSPQPLLKAGGAPGGNPTLYQDLVRVSATITNTGNVAGYEVPQLYVSLGGPNEPRVVLRKFDRIFLAPGEQKVWTTTLNRRDLANWDVEAQDWVITKYPKKVHVGSSSRKLPLRAPLPRVY

SEQ ID NO: 123 - protein, 532 aa, Aspergillus fumigatus
MLASTFSYRMYKTALILAALLGSGQAQQVGTSQAEVHPSMTWQSCTAGGSCTTNNGKVVIDANWRWVHKVGDYTNCYTGNTWDTTICPDDATCASNCALEGANYESTYGVTASGNSLRLNFVTTSQQKNIGSRLYMMKDDSTYEMFKLLNQEFTFDVDVSNLPCGLNGALYFVAMDADGGMSKYPTNKAGAKYGTGYCDSQCPRDLKFINGQANVEGWQPSSNDANAGTGNHGSCCAEMDIWEANSISTAFTPHPCDTPGQVMCTGDACGGTYSSDRYGGTCDPDGCDFNSFRQGNKTFYGPGMTVDTKSKFTVVTQFITDDGTSSGTLKEIKRFYVQNGKVIPNSESTWTGVSGNSITTEYCTAQKSLFQDQNVFEKHGGLEGMGAALAQGMVLVMSLWDDHSANMLWLDSNYPTTASSTTPGVARGTCDISSGVPADVEANHPDAYVVYSNIKVGPIGSTFNSGGSNPGGGTTTTTTTQPTTTTTTAGNPGGTGVAQHYGQCGGIGWTGPTTCASPYTCQKLNDYYSQCL

SEQ ID NO: 124 - protein, 454 aa, Aspergillus fumigatus
MKHLASSIALTLLLPAVQAQQTVWGQCGGQGWSGPTSCVAGAACSTLNPYYAQCIPGATATSTTLTTTTAATTTSQTTTKPTTTGPTTSAPTVTASGNPFSGYQLYANPYYSSEVHTLAMPSLPSSLQPKASAVAEVPSFVWLDVAAKVPTMGTYLADIQAKNKAGANPPIAGIFVVYDLPDRDCAALASNGEYSIANNGVANYKAYIDAIRAQLVKYSDVHTILVIEPDSLANLVTNLNVAKCANAQSAYLECVDYALKQLNLPNVAMYLDAGHAGWLGWPANLGPAATLFAKVYTDAGSPAAVRGLATNVANYNAWSLSTCPSYTQGDPNCDEKKYINAMAPLLKEAGFDAHFIMDTSRNGVQPTKQNAWGDWCNVIGTGFGVRPSTNTGDPLQDAFVWIKPGGESDGTSNSTSPRYDAHCGYSDALQPAPEAGTWFQAYFEQLLTNANPSF

SEQ ID NO: 125 - protein, 459 aa, Trichoderma reesei
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVSITRKYQQNGVDIPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQCL

SEQ ID NO: 126 - protein, 515 aa, Bacillus stearothermophilus
AAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 127 - protein, 177 aa, Thermoascus aurantiacus
TRISSCSGSRQSALTTALRNAASLANAAADAAQSGSASKFSEYFKTTSSSTRQTVAARLRAVAREASSSSSGATTYYCDDPYGYCSSNVLAYTLPSYNIIANCDIFYTYLPALTSTCHAQDQATTALHEFTHAPGVYSPGTDDLAYGYQAAMGLSSSQAVMNADTYALYANAIYLGC

SEQ ID NO: 128 - protein, 412 aa, Pyrococcus furiosus
AELEGLDESAAQVMATYVWNLGYDGSGITIGIIDTGIDASHPDLQGKVIGWVDFVNGRSYPYDDHGHGTHVASIAAGTGAASNGKYKGMAPGAKLAGIKVLGADGSGSISTIIKGVEWAVDNKDKYGIKVINLSLGSSQSSDGTDALSQAVNAAWDAGLVVVVAAGNSGPNKYTIGSPAAASKVITVGAVDKYDVITSFSSRGPTADGRLKPEVVAPGNWIIAARASGTSMGQPINDYYTAAPGTSMATPHVAGIAALLLQAHPSWTPDKVKTALIETADIVKPDEIADIAYGAGRVNAYKAINYDNYAKLVFTGYVANKGSQTHQFVISGASFVTATLYWDNANSDLDLYLYDPNGNQVDYSYTAYYDFEKVGYYNPTDGTWTIKVVSYSGSANYQVDVVSDGSLSQPGSS

SEQ ID NO: 129 - protein, 325 aa, Palaeococcus ferrophilus
GKPKPSQPPQEVPWGIERVKAPSVWSTTDGSSNGVIQVAILDTGIDYDHPDLAANLAWGVSTLRGRVSTKPKDYRDQNGHGTHVAGTIAALNNDIGVVGVAPGVQIYAIRVLDASGRGSYSDIAIGIEQAILGPDGVADKDGDGIIAGDPDDDAAEVISMSLGGSADDSYLHDMIIQAYNAGIVIVAASGNEGASSPSYPAAYPEVIAVGASDINDNIASFSNRQPEVSAPGVDVLSTYPDDTYKTLSGTSMATPHVSGVVALIQAAHFNKYGTILPVGTFDDMSKNTVRGILHITADDLGSPGWDVDYGYGIVRADLAVQAALG

SEQ ID NO: 130 - protein, 595 aa, Penicillium oxalicum
RPDPKGGNLTPFIHKEGERSLQGILDNLGGRGKKTPGTAAGLFIASPNTENPNYYYTWTRDSALTAKCLIDLFEDSRAKFPIDRKYLETGIRDYKSSQAILQSVSNPSGTLKDGSGLGEPKFEIDLNPFSGAWGRPQRDGPALRATAMITYANYLISHGQKSDVSQVMWPIIANDLAYVGQYWNNTGFDLWEEVDGSSFFTIAVQHRALVEGSQLAKKLGKSCDACDSQPPQILCFLQSFWNGKYITSNINTQASRSGIDLDSVLGSIHTFDPEAACDDATFQPCSARALANHKVYVDSFRSIYKINAGLAEGSAANVGRYPEDVYQGGNPWYLATLGASELLYDALYQWDRLGKLEVSETSLSFFKDFDATVKIGSYSRNSKTYKKLTQSIKSYADGFIQLVQQYTPSNGSLAEQYDRNTAAPLSANDLTWSFASFLTATQRRDAVVPPSWGAKSANKVPTTCSASPVVGTYKAPTATFSSKTKCVPAKDIVPITFYLIENTYYGENVFMSGNITALGNWDAKKGFPLTANLYTQDQNLWFASVEFIPAGTPFEYKYYKVEPNGDITWEKGPNRVFVAPTGCPVQPHSNDVWQF

SEQ ID NO: 131 - protein, 556 aa, Trametes cingulata
QSSAADAYVASESPIAKAGVLANIGPSGSKSNGAKAGIVIASPSTSNPNYLYTWTRDSSLVFKALIDQFTTGEDTSLRTLIDEFTSAEAILQQVPNPSGTVSTGGLGEPKFNIDETAFTDAWGRPQRDGPALRATAIITYANWLLDNKNTTYVTNTLWPIIKLDLDYVASNWNQSTFDLWEEINSSSFFTTAVQHRALREGATFANRIGQTSVVSGYTTQANNLLCFLQSYWNPTGGYITANTGGGRSGKDANTVLTSIHTFDPAAGCDAVTFQPCSDKALSNLKVYVDAFRSIYSINSGIASNAAVATGRYPEDSYMGGNPWYLTTSAVAEQLYDALIVWNKLGALNVTSTSLPFFQQFSSGVTVGTYASSSSTFKTLTSAIKTFADGFLAVNAKYTPSNGGLAEQYSRSNGSPVSAVDLTWSYAAALTSFAARSGKTYASWGAAGLTVPTTCSGSGGAGTVAVTFNVQATTVFGENIYITGSVPALQNWSPDNALILSAANYPTWSITVNLPASTTIEYKYIRKFNGAVTWESDPNNSITTPASGTFTQNDTWR

SEQ ID NO: 132 - protein, 591 aa, Talaromyces emersonii
ATGSLDSFLATETPIALQGVLNNIGPNGADVAGASAGIVVASPSRSDPNYFYSWTRDAALTAKYLVDAFIAGNKDLEQTIQQYISAQAKVQTISNPSGDLSTGGLGEPKFNVNETAFTGPWGRPQRDGPALRATALIAYANYLIDNGEASTADEIIWPIVQNDLSYITQYWNSSTFDLWEEVEGSSFFTTAVQHRALVEGNALATRLNHTCSNCVSQAPQVLCFLQSYWTGSYVLANFGGSGRSGKDVNSILGSIHTFDPAGGCDDSTFQPCSARALANHKVVTDSFRSIYAINSGIAEGSAVAVGRYPEDVYQGGNPWYLATAAAAEQLYDAIYQWKKIGSISITDVSLPFFQDIYPSAAVGTYNSGSTTFNDIISAVQTYGDGYLSIVEKYTPSDGSLTEQFSRTDGTPLSASALTWSYASLLTASARRQSVVPASWGESSASSVPAVCSATSATGPYSTATNTVWPSSGSGSSTTTSSAPCTTPTSVAVTFDEIVSTSYGETIYLAGSIPELGNWSTASAIPLRADAYTNSNPLWYVTVNLPPGTSFEYKFFKNQTDGTIVWEDDPNRSYTVPAYCGQTTAILDDSWQ

SEQ ID NO: 133 - protein, 555 aa, Pycnoporus sanguineus
QSSAVDAYVASESPIAKQGVLNNIGPNGSKAHGAKAGIVVASPSTENPDYLYTWTRDSSLVFKLLIDQFTSGDDTSLRGLIDDFTSAEAILQQVSNPSGTVSTGGLGEPKFNIDETAFTGAWGRPQRDGPALRATSIIRYANWLLDNGNTTYVSNTLWPVIQLDLDYVADNWNQSTFDLWEEVDSSSFFTTAVQHRALREGATFASRIGQSSVVSGYTTQADNLLCFLQSYWNPSGGYVTANTGGGRSGKDSNTVLTSIHTFDPAAGCDAATFQPCSDKALSNLKVYVDAFRSIYTINNGIASNAAVATGRYPEDSYMGGNPWYLTTSAVAEQLYDALYVWDQLGGLNVTSTSLAFFQQFASGLSTGTYSASSSTYATLTSAIRSFADGFLAINAKYTPADGGLAEQYSRNDGTPLSAVDLTWSYAAALTAFAAREGKTYGSWGAAGLTVPASCSGGGGATVAVTFNVQATTVFGENIYITGSVAALQNWSPDNALILSAANYPTWSITVNLPANTVVQYKYIRKFNGQVTWESDPNNQITTPSGGSFTQNDVWR

SEQ ID NO: 134 - protein, 556 aa, Gloeophyllum sepiarium
QSVDSYVSSEGPIAKAGVLANIGPNGSKASGASAGVVVASPSTSDPDYWYTWTRDSSLVFKSLIDQYTTGIDSTSSLRTLIDDFVTAEANLQQVSNPSGTLTTGGLGEPKFNVDETAFTGAWGRPQRDGPALRSTALITYGNWLLSNGNTSYVTSNLWPIIQNDLGYVVSYWNQSTYDLWEEVDSSSFFTTAVQHRALREGAAFATAIGQTSQVSSYTTQADNLLCFLQSYWNPSGGYITANTGGGRSGKDANTLLASIHTYDPSAGCDAATFQPCSDKALSNLKVYVDSFRSVYSINSGVASNAAVATGRYPEDSYQGGNPWYLTTFAVAEQLYDALNVWESQGSLEVTSTSLAFFQQFSSGVTAGTYSSSSSTYSTLTSAIKNFADGFVAINAKYTPSNGGLAEQYSKSDGSPLSAVDLTWSYASALTAFEARNNTQFAGWGAAGLTVPSSCSGNSGGPTVAVTFNVNAETVWGENIYLTGSVDALENWSADNALLLSSANYPTWSITVNLPASTAIEYKYIRKNNGAVTWESDPNNSITTPASGSTTENDTWR

SEQ ID NO: 135 - protein, 559 aa, Gloeophyllum trabeum
QSVDSYVGSEGPIAKAGVLANIGPNGSKASGAAAGVVVASPSKSDPDYWYTWTRDSSLVFKSLIDQYTTGIDSTSSLRSLIDSFVIAEANIQQVSNPSGTLTTGGLGEPKFNVDETAFTGAWGRPQRDGPALRATALITYGNWLLSNGNTTWVTSTLWPIIQNDLNYVVQYWNQTTFDLWEEVNSSSFFTTAVQHRALREGAAFATKIGQTSSVSSYTTQAANLLCFLQSYWNPTSGYITANTGGGRSGKDANTLLASIHTYDPSAGCDATTFQPCSDKALSNLKVYVDSFRSVYSINSGIASNAAVATGRYPEDSYQGGNPWYLTTFAVAEQLYDALNVWAAQGSLNVTSISLPFFQQFSSSVTAGTYASSSTTYTTLTSAIKSFADGFVAINAQYTPSNGGLAEQFSRSNGAPVSAVDLTWSYASALTAFEARNNTQFAGWGAVGLTVPTSCSSNSGGGGGSTVAVTFNVNAQTVWGENIYITGSVDALSNWSPDNALLLSSANYPTWSITVNLPASTAIQYKYIRKNNGAVTWESDPNNSITTPASGSVTENDTWR

SEQ ID NO: 136 - protein, 583 aa, Rhizomucor pusillus
ATSDDWKGKAIYQLLTDRFGRADDSTSNCSNLSNYCGGTYEGITKHLDYISGMGFDAIWISPIPKNSDGGYHGYWATDFYQLNSNFGDESQLKALIQAAHERDMYVMLDVVANHAGPTSNGYSGYTFGDASLYHPKCTIDYNDQTSIEQCWVADELPDIDTENSDNVAILNDIVSGWVGNYSFDGIRIDTVKHIRKDFWTGYAEAAGVFATGEVFNGDPAYVGPYQKYLPSLINYPMYYALNDVFVSKSKGFSRISEMLGSNRNAFEDTSVLTTFVDNHDNPRFLNSQSDKALFKNALTYVLLGEGIPIVYYGSEQGFSGGADPANREVLWTTNYDTSSDLYQFIKTVNSVRMKSNKAVYMDIYVGDNAYAFKHGDALVVLNNYGSGSTNQVSFSVSGKFDSGASLMDIVSNITTTVSSDGTVTFNLKDGLPAIFTSATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 137 - protein, 1020 aa, Talaromyces funiculosus
LPFNERVDQVLRSYEVTSKLDSRSTKPSKHGHTYQTQFLGVTWDQRNWRLQSTVLDQGHYESRGSIANGYIGLNVAGAGPLFELDSPVDGDVINGWPLFSRRQTFAGLAGFYDLQPRTNGTNFPWLSQYGDDSAISGVPHWGGMVLDLGDGEYLDATVDNSTISDYTTTYDYKAGVLSWDYKWTPKNANGSFGISYKIFANKLDVNQAVVQLSITPSTNGSASVVNVIDGYAAVRTDFVSSGNESDVVYTAVKPNGVTNVTAWIYTALDGDDAFDISSAALVNDKPYVHQNDSSIAQSVNVTFTAGTTITINKFVGAASTDAFPDPQSTAREAALSARRRGFDDLFRSHISEWAQVMPDDSVDDFTLANGTLPNDTFIIESAVMAVVNPYYLLQNTVGPNALRRVNNAPVNDWSIPVGGLTSDSYAGQIFWDADVWMQPGLVAAFPESAKRITNYRAAKYSQALENAKTAYTSSQNQTWFSPDAAIYSWTSGRVGNCTATGPCWDYEYHLNGDIGISLVNEWVVSGDNETFKNKHFPIYNSIATLYGDLLKKNGSYYTLTNMTDPDEYANNVDAGGYTMTLISQTLSNANAFRKQFGMNENTTWTEMADNILLIRENDVTLEYTTMNNSVAVKQADVILSTFPLDYTKNYTTSAALNDLDYYALKQSPDGPGMTYAIFSIVANDVSPSGCSAYTYAQYSYDPYIRGPFFQFSEQLLDDYTINGGTHPAFPFLTGHGGANQVVLYGYLGLRLLPDDMLHIDPNLPPQIPSIKYRTFYWRGWPIQAASNYTHTTIQRATTVAPLSTADPTYANKSIHVSVGHNTVNSTTYSLSANGSALVVPNRQIGSINTVAGNVVQCKSVLSTDAYQKGQYPISAVDGAASTKWQPEFAANISSLTVDLTGSNVSSVSGFYFDWAQAPPTNITVLLHNSSSAALASSGDKPGSSAVTLNITISNPYNASTYNANIIALPSSNSTNYTFPAPVPKPRYATLFVQGNQALDETDTKSGNGTGATVAEWAILS

SEQ ID NO: 138 - protein, 694 aa, Myceliophthora sepedonium
MALRHIAAAAIAGLASRTAALYINGSVTAPCDSPIYCQGELLKAVELARPFVDSKTFVDMPTIKPVDEVLAAFSKLSLPLSNNSELNAFLYENFAQAGHELEEVPDSELETDAKFLDKLEDRTIKEFVGKVIDIWPDLTRRYAGPSNCTECANSFIPVNRTFVVAGGRFREPYYWDSYWIVEGLLRTGGAFTHISKNIIENFLDFVDTIGFIPNGARIYYLNRSQPPLLTLMVKSYVDYTNDTSILDRALPLLIKEHEFFMNNRTVSITGSNGKEYTLNRYHVENNQPRPESFREDYITANNGSYYASSGIIYPVKTPLNETEKAALYSNLATGAESGWDYTSRWLGVPSDAARDVYFPLRSLNVRDIVPVDLNSILYQNEVIIAEYLEKAGNSSAAKRFATAAEQRSEAMYSLMWNATHWSYFDYNLTDNTQHIFVPADEDTAPQDRIEAPPGQQVFFHIAQLYPFWTGAAPASLKANPLAVQQAYARVARMLDIKKGAIPATNYRTGQQWDQPNVWPPLQHILMKGLLNTPATFGKSDPAYQSVQNLALRLAQRYLDSTFCTWYATGGSTSDFPQLEGVTPGATGVMFEKYADNATNVAGGGGEYEVVEGFGWTNGVLIWAADVFGNKLKRPDCGNITAAHTHSSAKRGLEENKLPRRAVELDPWDAAWTKMFGRSKLRRREAEDVRKRWMS

SEQ ID NO: 139 - protein, 186 aa, Thermobifida cellulosilytica
ADVIGGNPYYFGGYRCSIGFSVRKGSDTGFATAGHCGETGTLTRSPEGVVAGSYFPGRDMGWVRLTGADTVTPLVNRYDGGTVTVTGSQEAVTGSSVCRSGSTTGWRCGIIQSKNQTVRYAEGTVTGLTRTTACAEAGDSGGPWLTGSQAQGVTSGGSGNCRTGGITYFQPINPLLSYFGLELVTG

SEQ ID NO: 140 - protein, 186 aa, Thermobifida fusca
AAIIGGNPYYFGNYRCSIGFSVRQGSQTGFATAGHCGSTGTRVSSPSGTVAGSYFPGRDMGWVRITSADTVTPLVNRYNGGTVTVTGSQEAATGSSVCRSGATTGWRCGTIQSKNQTVRYAEGTVTGLTRTTACAEGGDSGGPWLTGSQAQGVTSGGTGDCRSGGITFFQPINPLLSYFGLQLVTG

SEQ ID NO: 141 - protein, 186 aa, Thermobifida halotolerans
TDIIGGNPYYFDGYRCSIGFSVRRGSESGFATAGHCGEEGTETSDPEGTVAGAYFPGRDMGWVRITDADTVTPLVNRYNGENVTVAGSREAATGSSVCRSGSTTGWRCGTIRSKNQTVRYIEGTVTGLTRTTACAEGGDSGGPWLTGSQGQGVTSGGSGNCTLGGVTYFQPLNPLLSHFDLDLVTG

SEQ ID NO: 142 - protein, 325 aa, Thermococcus nautili
LVPEPTQPAQEIPWGIERVKAPDTWSITTGASNGVIEVAILDTGIDWDHPDLKDNIAWGVSTIGGEVSTDPADWYDGNGHGTHVAGTIAALNNDIGVVGVAPNVEIYAIKVLDDRGSGAYTDIAIGIEQALLGPDGILDKDGDGIIVGDPDDDAAEVISMSLGGPSDDEYLHDMIIKAYNYGVVIVAASGNEAADQPSYPAIYPEVIAVGATDSSDAVAYFSNLQPEVSAPGVDVLSTYPDDTYESLSGTSMATPHVSGVVALIQAAYYNKYGKVLPVGTFDDMNTNTVRGILHVTADDLGDPGWDIYYGYGIVRADLAVQAALG

SEQ ID NO: 143 - DNA, 1096 bp, Aspergillus nidulans FGSC A4
  sig_peptide (1)..(57)
  exon (1)..(347)
  Intron (348)..(414)
  exon (415)..(1096)
atgcgccttacgtctttgtttccagccttgagtctggcagctgagcttgccagtgctgcctatgtgctgcaggacgactacagccccgatgtgtttttcgacaagtttacattctttacagatgctgatccgacccacggccatgtcgactacgttgatcgaggcacggcgcagagcgcaggcctaatctcctcaggctcttccgtctacatgggcgttgaccacaccaacatcgccagctcgggccgccaaagcgtgcgtctttcaagcacgcagacctaccaccacggcctcttcatcatcgacctttcacacatgcctacaggctgcggtacctggccggccttgtaagtccatccgacactaacctatcaaatccatttcaacagaaacaagggcactgatagactacagctggattctcggcccggactggcccaacggcggtgagattgacgttattgaaaacgtcaacgtcgcaacgaacaaccacatgaccttgcacaccagtgatggctgcacaatcgactcttccggtttcacaggaaccctgctcacctcaaactgcttcgtcaatgctcccggccaagccaacaatgccggctgcggcattcaatcccccgacagcaactcctacggcgctgggttcaattccaactccggcggcgtctatgccaccgaatggacgagtgaccatatctcaatttggtttttcccgcgcagttctattccctctgatatcacggctgggaatccagatccgagtacatggggcacacctgcagcacgatttgcagggaactgcgacattgagtcccacttcacagatatgcagattatctttgatatcacgttttgcggggactgggcagggaatgtctgggaaagcagtacttgcgcttcgttgggtagctgcactgattatgtgtcgaacaatccagaggcatttgcggatgcttactgggatattaattctcttagggtttatcaggattcggcggctgcgaagagggatgagattgaggggcgggagaagacaagtgctaaaggttttccgaggaagtcgatgagggcgaggagagacgctggattatag

SEQ ID NO: 144 - protein, 342 aa, Aspergillus nidulans FGSC A4
MRLTSLFPALSLAAELASAAYVLQDDYSPDVFFDKFTFFTDADPTHGHVDYVDRGTAQSAGLISSGSSVYMGVDHTNIASSGRQSVRLSSTQTYHHGLFIIDLSHMPTGCGTWPAFWILGPDWPNGGEIDVIENVNVATNNHMTLHTSDGCTIDSSGFTGTLLTSNCFVNAPGQANNAGCGIQSPDSNSYGAGFNSNSGGVYATEWTSDHISIWFFPRSSIPSDITAGNPDPSTWGTPAARFAGNCDIESHFTDMQIIFDITFCGDWAGNVWESSTCASLGSCTDYVSNNPEAFADAYWDINSLRVYQDSAAAKRDEIEGREKTSAKGFPRKSMRARRDAGL

SEQ ID NO: 145 - protein, 323 aa, Aspergillus nidulans FGSC A4
AYVLQDDYSPDVFFDKFTFFTDADPTHGHVDYVDRGTAQSAGLISSGSSVYMGVDHTNIASSGRQSVRLSSTQTYHHGLFIIDLSHMPTGCGTWPAFWILGPDWPNGGEIDVIENVNVATNNHMTLHTSDGCTIDSSGFTGTLLTSNCFVNAPGQANNAGCGIQSPDSNSYGAGFNSNSGGVYATEWTSDHISIWFFPRSSIPSDITAGNPDPSTWGTPAARFAGNCDIESHFTDMQIIFDITFCGDWAGNVWESSTCASLGSCTDYVSNNPEAFADAYWDINSLRVYQDSAAAKRDEIEGREKTSAKGFPRKSMRARRDAGL

SEQ ID NO: 146 - DNA, 939 bp, Trichoderma harzianum
  sig_peptide (1)..(57)
  exon (1)..(798)
  Intron (799)..(858)
  exon (859)..(939)
atgtggtctcccaaggttgctgctgccgtcctcgcctttgttggtgctaccaacgcctggcagcccccgacctacagcggcttcaacttggtctggactgacaccttcgctggcaacggtggcacttctcctaaccagaacaactggaacatcatcaccggaaacttgaacgtcaacgccgagcaggagacctactcctccagcaccgccaatgttcagctcagtggtggcagcacccttcagctggtcccctggagagacagcagcaagggaaccagcacctttggtggctggacctccggtcgtcttgagtccaagtacacattcactcccgcggccggcaaggtcacccgtcttgaagccgccatccgcttcggcagcaacgctcaggccaacaagcagggtatctggcctgctttctggatgctgggtgactccctccgtcaaccgggcggcagctggcccaactgtggtgagatcgacatcatggagactgtcgacggccaggctaccggccacggtacccttcactgcgacgtctaccccggcggtatctgcaacgagggtaacggtattggaggccctgtcaacatcgccaacgtcaacgactggcacgcttggcgtgttgagatcgaccgcactcccagcagctggcaatccgagaccctcacctggtccctcgacggcaccaactacttccagatcactggttctcgcattggcaaccagggcgtctggaacaacattgctcacagccccctcttcttcattcttaacgttgctgtcggtggcaactgggtacgttcttccataatatctgctttgagtttgatcagacacagctaacacatgtaatagcctggcaaccccaacagcgctaccctcgatggctacggaagcatgatggaggttggctacgtcgctcagtactctacctaa

SEQ ID NO: 147 - protein, 292 aa, Trichoderma harzianum
MWSPKVAAAVLAFVGATNAWQPPTYSGFNLVWTDTFAGNGGTSPNQNNWNIITGNLNVNAEQETYSSSTANVQLSGGSTLQLVPWRDSSKGTSTFGGWTSGRLESKYTFTPAAGKVTRLEAAIRFGSNAQANKQGIWPAFWMLGDSLRQPGGSWPNCGEIDIMETVDGQATGHGTLHCDVYPGGICNEGNGIGGPVNIANVNDWHAWRVEIDRTPSSWQSETLTWSLDGTNYFQITGSRIGNQGVWNNIAHSPLFFILNVAVGGNWPGNPNSATLDGYGSMMEVGYVAQYST

SEQ ID NO: 148 - protein, 273 aa, Trichoderma harzianum
WQPPTYSGFNLVWTDTFAGNGGTSPNQNNWNIITGNLNVNAEQETYSSSTANVQLSGGSTLQLVPWRDSSKGTSTFGGWTSGRLESKYTFTPAAGKVTRLEAAIRFGSNAQANKQGIWPAFWMLGDSLRQPGGSWPNCGEIDIMETVDGQATGHGTLHCDVYPGGICNEGNGIGGPVNIANVNDWHAWRVEIDRTPSSWQSETLTWSLDGTNYFQITGSRIGNQGVWNNIAHSPLFFILNVAVGGNWPGNPNSATLDGYGSMMEVGYVAQYST

SEQ ID NO: 149 - DNA, 2681 bp, Hamigera inflata
  sig_peptide (1)..(54)
  exon (1)..(337)
  Intron (338)..(390)
  exon (391)..(849)
  Intron (850)..(904)
  exon (905)..(2084)
  Intron (2085)..(2141)
  exon (2142)..(2234)
  Intron (2235)..(2299)
  exon (2300)..(2681)
atgaaatttgattttgccgctacttatgctttgatcctcgttggtgcaaatgcgcagcttcaggacatccccgttgtagaccgcgtggtcagctcggctctaagctctctctcggcgtatgtcacataccatgcgccaactggaacggctgctgctgctttggcctctgcgacagcgagtaccgattcaacaaagcatgacacagttacggtaaatgcagctgttgctgatgtaccgtactggttggcggacatatctcatcaaggcatcgcggcgttcaacccgaacccatcgggttatgcagtcttccgcaacgtcaaagactatggtgctaagggtatgtacatccactgagtgttctatgttacttgtctgacgaacagcgtctaggtgatggagtcacagacgacaccgctgcgatcaatgcagcgataagtgctggtggtcgatttagcccagcaagtcgtcaatcttccacgacgactcctgccattgtttacttccctgctggtacctatctgatctctgcaccgatcattgactactatttcacccagctcgttggcaacccgaactcgctgccaattatcaaggccagctcttcgtttcctcctacttggatgattgatggggatcaataccagagtgacggcaatcaaggctggacatctaccaacgtgttcttccggcaaattcgaaacttgattttggacatgactgcgatccctccaagtacggcagcaactggtatccactggccgactggccaggcaacaagcattcagaatgtggagattcacatgagttctgctccaggaacccagcatcaaggtctattcattgaaaatggtatgatttgtttccccccccagcacgggttacacttcttgctaacctagtataggctctggcggcttcatcatcgacgtcaccaccactggaggtagatatggcgcaaatctcggaaaccaacagttcacaatgcgtaacctcaaaatctcggacgcgacgtatggaatctggcagatctggaactggggatggacataccaggggatcactatcaccaactgctcgactgcattcgccatgaccaactcgggagttggtaatcagcaggttgggtctgtcaacatcatcgacagtaccattcaagactgtccgatttttgtggacactgcctggcagagctccacttatagcaatggcagtctgatcttggagaatgtcaagctaagcaatgttcctgtagcagtacatggcccaagtggcactgttctagctggtggaaccacaactatctctgcatggggtcaaggccacaagtacacgccgtctgggccgactaacttccagggcacatttacaccacctacacgacctagcgagctgcttgccggcggatcctccaactactacactaagacgaaacctcaatatgaagcctcacccctggcttcattcgtgagcatccgaagcgctggcgcaaagggtgatgggtcgactgacgacacagccgccattcagtctgcactgcggtccgccgcatcctcgggaaagattgtcttcttcgaccagggtgtctacaaagtgacaaacactatctatgttccgcccggttcgcgggtggttggcgaatccttcccagtgattatggctgcgggaagcacgttctcaaacatcaacaatcccgtgccggttgttcaaatcggaaagcccggagactcgggtttcgttgaatggtcagacatgtttttgagcactcagggctcaactcccggagcggtactcattgagtggaatctggcggccaccgaaggctcgggcatgtgggaggtccacgcccgcgtaggaggctttgccggctcacagcaactaaatgcgcaatgcccaaagactgctgcagtttcctccgcctgtttggctgcatacatgtcaatgcatattaccagatctgccagcaatgtgtacttggacaacgcctggatttggacggcagaccatgacctggatgacggactgaacactcaaatttcggtttacactggtcgtggactcctcatcgagggaaagaatgtttggctgtaagtgttaaaaggctatgaatattcatgttcacccaaactgataatctcatacagttatggaacgtccgtggagcaccatgcattgtatcaatatcagctctccggtgctcagaatgtcgttgctggcttcgtgcaaaccgagacaccgtaagtccatctgagatttcttgattgtttcattaactgaccttttttttctttacttctgacaggtactggcaacccatccccgatgcagccaacggcccctatcccaggaacgccaccctcaaagatcccgactacagcacctgtctccccggaaactgtgatgctctctccctgcgcatcctcgacagccaaaacgtgattatttacggtgccggactgtacagctttttcaatcactacagtaccacttgctccaactaccccagcccggaggactgccagagcgagattttccgcatcgaaggcaatacgaacaatctggtggtgtattcgttgagcaccatcggtacgacaaacatgatcgtcaaggacggtacgtcgctggcgcattacagcgacaatttagctacgtatgccgataccattgcttacttcacgctgtga

SEQ ID NO: 150 - protein, 816 aa, Hamigera inflata
MKFDFAATYALILVGANAQLQDIPVVDRVVSSALSSLSAYVTYHAPTGTAAAALASATASTDSTKHDTVTVNAAVADVPYWLADISHQGIAAFNPNPSGYAVFRNVKDYGAKGDGVTDDTAAINAAISAGGRFSPASRQSSTTTPAIVYFPAGTYLISAPIIDYYFTQLVGNPNSLPIIKASSSFPPTWMIDGDQYQSDGNQGWTSTNVFFRQIRNLILDMTAIPPSTAATGIHWPTGQATSIQNVEIHMSSAPGTQHQGLFIENGSGGFIIDVTTTGGRYGANLGNQQFTMRNLKISDATYGIWQIWNWGWTYQGITITNCSTAFAMTNSGVGNQQVGSVNIIDSTIQDCPIFVDTAWQSSTYSNGSLILENVKLSNVPVAVHGPSGTVLAGGTTTISAWGQGHKYTPSGPTNFQGTFTPPTRPSELLAGGSSNYYTKTKPQYEASPLASFVSIRSAGAKGDGSTDDTAAIQSALRSAASSGKIVFFDQGVYKVTNTIYVPPGSRVVGESFPVIMAAGSTFSNINNPVPVVQIGKPGDSGFVEWSDMFLSTQGSTPGAVLIEWNLAATEGSGMWEVHARVGGFAGSQQLNAQCPKTAAVSSACLAAYMSMHITRSASNVYLDNAWIWTADHDLDDGLNTQISVYTGRGLLIEGKNVWLYGTSVEHHALYQYQLSGAQNVVAGFVQTETPYWQPIPDAANGPYPRNATLKDPDYSTCLPGNCDALSLRILDSQNVIIYGAGLYSFFNHYSTTCSNYPSPEDCQSEIFRIEGNTNNLVVYSLSTIGTTNMIVKDGTSLAHYSDNLATYADTIAYFTL

SEQ ID NO: 151 - protein, 798 aa, Hamigera inflata
QLQDIPVVDRVVSSALSSLSAYVTYHAPTGTAAAALASATASTDSTKHDTVTVNAAVADVPYWLADISHQGIAAFNPNPSGYAVFRNVKDYGAKGDGVTDDTAAINAAISAGGRFSPASRQSSTTTPAIVYFPAGTYLISAPIIDYYFTQLVGNPNSLPIIKASSSFPPTWMIDGDQYQSDGNQGWTSTNVFFRQIRNLILDMTAIPPSTAATGIHWPTGQATSIQNVEIHMSSAPGTQHQGLFIENGSGGFIIDVTTTGGRYGANLGNQQFTMRNLKISDATYGIWQIWNWGWTYQGITITNCSTAFAMTNSGVGNQQVGSVNIIDSTIQDCPIFVDTAWQSSTYSNGSLILENVKLSNVPVAVHGPSGTVLAGGTTTISAWGQGHKYTPSGPTNFQGTFTPPTRPSELLAGGSSNYYTKTKPQYEASPLASFVSIRSAGAKGDGSTDDTAAIQSALRSAASSGKIVFFDQGVYKVTNTIYVPPGSRVVGESFPVIMAAGSTFSNINNPVPVVQIGKPGDSGFVEWSDMFLSTQGSTPGAVLIEWNLAATEGSGMWEVHARVGGFAGSQQLNAQCPKTAAVSSACLAAYMSMHITRSASNVYLDNAWIWTADHDLDDGLNTQISVYTGRGLLIEGKNVWLYGTSVEHHALYQYQLSGAQNVVAGFVQTETPYWQPIPDAANGPYPRNATLKDPDYSTCLPGNCDALSLRILDSQNVIIYGAGLYSFFNHYSTTCSNYPSPEDCQSEIFRIEGNTNNLVVYSLSTIGTTNMIVKDGTSLAHYSDNLATYADTIAYFTL

SEQ ID NO: 152 - DNA, 1308 bp, Acremonium exiguum
  sig_peptide (1)..(48)
  CDS (1)..(1308)
atgaagcttttctggctggcgaccttctttgcagggatagcaactgctttacctgccattgatattcaacggcgccacgatggccctatcgtggcaaaccctggcccggtgtcagagatgattgtcacaaaagagacgactcttaatggcacccataaaggccctactgtggtagtccctcctcctgaggttcataccgagactattccactcccattgacctttgtcaataactttggcggagccatcaacgcatatctcgttggacgatgcccgaacaatgccgtctgtttcatacgcggcgacggaagcatcgtgtaccctagttccgggggatcgagcgttccagtatcagttcccagcgacagtgtcaagatccccgttggccagggacaaactctgaatctgaacctcccaaccgctatcaactctgctcgtatctactttgcagctggagacttacaatttggaatggtcagcacaccagctggtgatggcttggttcagccggctccaaacagcgcaacggatccttcttccggaatcaactggggctttgttgagttgaacgttgacccaaatggcactattaacacaaacatctcttatgtcgactttgcgggacttgttcttggcatgcaacttgaggacaacaatgggccaacacagactgctcggggtctgagggctggttccgctgacgcgatctgcaacgacctccgtgctcaagcctccagagatggatatccgtggggcaacatgtgcgtcacttcttcaagcggctcggtcgttcgtgtactttctccgaacagctactcagcagttgacggcggtgcgtttgccaactattggactggctacgtggaccaggtttggtctcgctactctagtcagcctttacagatgacctctacttgcaccgtcagtggaaacaccatgacttgcggcggtggcgacgaccttcagtaccaaaagccctccgccaccgatatatggggctgcaatggcggaccatttgcgaatactggcaacaatgtacacaaagctaaccttgcgatcctctgcgctgccttccatcggtctactcttttgctcaatggtggtgatgttcagcctagtctaccatcctcaagctactacacagtcgactcgaccaactattactcgaaatcggtacataacaatgaacttgatggtagagggtatgccttcccttacgatgatgtaaatgcgaatggcgagaacaattccgggttgcttgctactgcgaaccctcgatcattgttgatttggattggtggaaattga

SEQ ID NO: 153 - protein, 435 aa, Acremonium exiguum
MKLFWLATFFAGIATALPAIDIQRRHDGPIVANPGPVSEMIVTKETTLNGTHKGPTVVVPPPEVHTETIPLPLTFVNNFGGAINAYLVGRCPNNAVCFIRGDGSIVYPSSGGSSVPVSVPSDSVKIPVGQGQTLNLNLPTAINSARIYFAAGDLQFGMVSTPAGDGLVQPAPNSATDPSSGINWGFVELNVDPNGTINTNISYVDFAGLVLGMQLEDNNGPTQTARGLRAGSADAICNDLRAQASRDGYPWGNMCVTSSSGSVVRVLSPNSYSAVDGGAFANYWTGYVDQVWSRYSSQPLQMTSTCTVSGNTMTCGGGDDLQYQKPSATDIWGCNGGPFANTGNNVHKANLAILCAAFHRSTLLLNGGDVQPSLPSSSYYTVDSTNYYSKSVHNNELDGRGYAFPYDDVNANGENNSGLLATANPRSLLIWIGGN

SEQ ID NO: 154 - protein, 419 aa, Acremonium exiguum
LPAIDIQRRHDGPIVANPGPVSEMIVTKETTLNGTHKGPTVVVPPPEVHTETIPLPLTFVNNFGGAINAYLVGRCPNNAVCFIRGDGSIVYPSSGGSSVPVSVPSDSVKIPVGQGQTLNLNLPTAINSARIYFAAGDLQFGMVSTPAGDGLVQPAPNSATDPSSGINWGFVELNVDPNGTINTNISYVDFAGLVLGMQLEDNNGPTQTARGLRAGSADAICNDLRAQASRDGYPWGNMCVTSSSGSVVRVLSPNSYSAVDGGAFANYWTGYVDQVWSRYSSQPLQMTSTCTVSGNTMTCGGGDDLQYQKPSATDIWGCNGGPFANTGNNVHKANLAILCAAFHRSTLLLNGGDVQPSLPSSSYYTVDSTNYYSKSVHNNELDGRGYAFPYDDVNANGENNSGLLATANPRSLLIWIGGN

What is claimed is:

1. A process for producing fermentation products from starch-containing material comprising the steps of:
   i) saccharifying the starch-containing material using a glucoamylase at a temperature below the initial gelatinization temperature;
   ii) fermenting using a fermenting organism;
   wherein at least one polypeptide having beta-1,6-glucanase activity and at least one polypeptide having endo- and/or exo-beta-1,3-glucanase activity are present or added during saccharifying step i) or fermenting step ii).

2. The process of claim 1, wherein the polypeptide having beta-1,6-glucanase activity is a member of a glycoside hydrolase (GH) family selected from the group consisting of families GH30, GH5, and GH131.

3. The process of claim 1, wherein the polypeptide having beta-1,3-glucanase activity is a member of a glycoside hydrolase (GH) family selected from the group consisting of families GH16, GH55, GH64 and GH131.

4. The process of claim 1, wherein the at least one polypeptide having beta-1,6-glucanase activity and the at least one polypeptide having beta-1,3-glucanase activity is selected from the combinations:
   i) GH5_15 and GH64;
   ii) GH5_15 and GH30_3 and GH16;
   iii) GH5_15 and GH64 and GH16;
   iv) GH5_15 and GH55_3;
   v) GH55_3 and GH64;
   vi) GH5_15 and GH55_3 and GH64;
   vii) GH5_15 and GH131;
   viii) GH16 and GH64;
   ix) G5_15 and GH30_3;
   x) GH16 and GH55_3; and
   xi) GH131 and GH131.

5. A process for producing fermentation products from starch-containing material comprising the steps of:
   i) liquefying the starch-containing material at a temperature above the initial gelatinization temperature using an alpha-amylase;

ii) saccharifying using a glucoamylase;

iii) fermenting using a fermenting organism;

wherein at least one polypeptide having beta-1,6-glucanase activity and at least one polypeptide having endo- and/or exo-beta-1,3-glucanase activity are present or added during saccharifying step ii) or fermenting step iii).

6. The process of claim 5, wherein the polypeptide having beta-1,6-glucanase activity is a member of a glycoside hydrolase (GH) family selected from the group consisting of families GH30, GH5, and GH131.

7. The process of claim 5, wherein the polypeptide having beta-1,3-glucanase activity is a member of a glycoside hydrolase (GH) family selected from the group consisting of families GH16, GH55, GH64 and GH131.

8. The process of claim 5, wherein the at least one polypeptide having beta-1,6-glucanase activity and the at least one polypeptide having beta-1,3-glucanase activity is selected from the combinations:

i) GH5_15 and GH64;

ii) GH5_15 and GH30_3 and GH16;

iii) GH5_15 and GH64 and GH16;

iv) GH5_15 and GH55_3;

v) GH55_3 and GH64;

vi) GH5_15 and GH55_3 and GH64;

vii) GH5_15 and GH131;

viii) GH16 and GH64;

ix) G5_15 and GH30_3;

x) GH16 and GH55_3; and xi) GH131 and GH131.

9. A process for producing fermentation products from cellulosic-containing material comprising the steps of:

i) optionally pretreating a cellulosic-containing material;

ii) saccharifying a cellulosic-containing material and/or pretreated cellulosic-containing material using a glucoamylase; and iii) fermenting using a fermenting organism;

wherein at least one polypeptide having beta-1,6-glucanase activity and at least one polypeptide having endo- and/or exo-beta-1,3-glucanase activity are present or added during saccharifying step ii) or fermenting step iii).

10. The process of claim 9, wherein the polypeptide having beta-1,6-glucanase activity is a member of a glycoside hydrolase (GH) family selected from the group consisting of families GH30, GH5, and GH131.

11. The process of claim 9, wherein the polypeptide having beta-1,3-glucanase activity is a member of a glycoside hydrolase (GH) family selected from the group consisting of families GH16, GH55, GH64 and GH131.

12. The process of claim 9, wherein the at least one polypeptide having beta-1,6-glucanase activity and the at least one polypeptide having beta-1,3-glucanase activity is selected from the combinations:

i) GH5_15 and GH64;

ii) GH5_15 and GH30_3 and GH16;

iii) GH5_15 and GH64 and GH16;

iv) GH5_15 and GH55_3;

v) GH55_3 and GH64;

vi) GH5_15 and GH55_3 and GH64;

vii) GH5_15 and GH131;

viii) GH16 and GH64;

ix) G5_15 and GH30_3;

x) GH16 and GH55_3; and xi) GH131 and GH131.

* * * * *